United States Patent
Katada et al.

(10) Patent No.: US 12,448,451 B2
(45) Date of Patent: Oct. 21, 2025

(54) ANTI-CTLA-4 ANTIBODY AND USE THEREOF

(71) Applicants: Chugai Seiyaku Kabushiki Kaisha, Tokyo (JP); Osaka University, Osaka (JP)

(72) Inventors: Hitoshi Katada, Singapore (SG); Kanako Tatsumi, Shizuoka (JP); Yutaka Matsuda, Tokyo (JP); Shun Shimizu, Shizuoka (JP); Masaki Kamimura, Kanagawa (JP); Yasunori Komori, Shizuoka (JP); Yuji Hori, Shizuoka (JP); Tomoyuki Igawa, Tokyo (JP); Hiroki Kawauchi, Kanagawa (JP); Hiroki Hayashi, Kanagawa (JP); Hiroaki Susumu, Kanagawa (JP); Shimon Sakaguchi, Osaka (JP)

(73) Assignees: CHUGAI SEIYAKU KABUSHIKI KAISHA, Tokyo (JP); OSAKA UNIVERSITY, Osaka (JP)

( * ) Notice: Subject to any disclaimer, the term of this patent is extended or adjusted under 35 U.S.C. 154(b) by 0 days.

(21) Appl. No.: 17/848,983

(22) Filed: Jun. 24, 2022

(65) Prior Publication Data
US 2023/0020377 A1    Jan. 19, 2023
US 2024/0002510 A2    Jan. 4, 2024

(30) Foreign Application Priority Data

Jun. 25, 2021 (JP) .................................. 2021-105804
Jun. 25, 2021 (JP) .................................. 2021-105823

(51) Int. Cl.
C07K 16/28      (2006.01)
A61K 39/00      (2006.01)

(52) U.S. Cl.
CPC .... *C07K 16/2818* (2013.01); *A61K 2039/505* (2013.01); *C07K 2317/52* (2013.01); *C07K 2317/56* (2013.01); *C07K 2317/92* (2013.01)

(58) Field of Classification Search
CPC ............ C07K 16/2812; C07K 2317/52; C07K 2317/56; C07K 2317/92; A61K 2039/505
See application file for complete search history.

(56) References Cited

U.S. PATENT DOCUMENTS 6,737,056 B1    5/2004  Presta
7,632,497 B2   12/2009  Stavenhagen et al.
(Continued)

FOREIGN PATENT DOCUMENTS

CA    2565961 A1    2/2006
CA    2815266 A1    5/2012
(Continued)

OTHER PUBLICATIONS

Edwards et al., The remarkable flexibility of the human antibody repertoire; isolation of over one thousand different antibodies to a single protein, BLyS. J Mol Biol. Nov. 14, 2003;334(1):103-18. (Year: 2003).*

(Continued)

*Primary Examiner* — Aurora M Fontainhas
*Assistant Examiner* — Selam Berhane
(74) *Attorney, Agent, or Firm* — Nixon & Vanderhye P.C.

(57) ABSTRACT

The present disclosure provides anti-CTLA-4 antibodies and methods of producing and using the antibodies. The present disclosure also provides nucleic acids encoding the anti-CTLA-4 antibodies and host cells containing the nucleic acids. Furthermore, the present disclosure provides polypeptides containing a variant Fc region containing amino acid (Continued)

alterations in a parent Pc region and methods of producing and using the polypeptides.

20 Claims, 58 Drawing Sheets

Specification includes a Sequence Listing.

(56) References Cited

U.S. PATENT DOCUMENTS

| | | |
|---|---|---|
| 7,951,917 B1 | 5/2011 | Arathoon et al. |
| 8,188,231 B2 | 5/2012 | Lazar et al. |
| 8,524,867 B2 | 9/2013 | Bernett et al. |
| 8,586,713 B2 | 11/2013 | Davis et al. |
| 8,592,562 B2 | 11/2013 | Kannan et al. |
| 9,200,060 B2 | 12/2015 | Kannan et al. |
| 9,228,017 B2 | 1/2016 | Igawa et al. |
| 9,562,109 B2 | 2/2017 | Von Kreudenstein et al. |
| 9,670,269 B2 | 6/2017 | Igawa et al. |
| 9,688,762 B2 | 6/2017 | Igawa et al. |
| 9,890,218 B2 | 2/2018 | Mimoto et al. |
| 10,011,858 B2 | 7/2018 | Igawa et al. |
| 10,066,018 B2 | 9/2018 | Igawa et al. |
| 10,196,445 B1 | 2/2019 | Engelhardt et al. |
| 10,251,945 B2 | 4/2019 | Engelhardt et al. |
| 10,253,091 B2 | 4/2019 | Igawa et al. |
| 10,766,960 B2 | 9/2020 | Igawa et al. |
| 10,934,344 B2 | 3/2021 | Igawa et al. |
| 10,961,530 B2 | 3/2021 | Igawa et al. |
| 11,013,802 B2 | 5/2021 | Van Dijk et al. |
| 11,124,576 B2 | 9/2021 | Igawa et al. |
| 11,142,563 B2 | 10/2021 | Igawa et al. |
| 11,168,344 B2 | 11/2021 | Igawa et al. |
| 11,332,533 B2 | 5/2022 | Igawa et al. |
| 11,359,016 B2 | 6/2022 | Lou et al. |
| 11,673,947 B2 | 6/2023 | Igawa et al. |
| 11,912,989 B2 | 2/2024 | Igawa et al. |
| 2006/0024298 A1 | 2/2006 | Lazar et al. |
| 2006/0134709 A1 | 6/2006 | Stavenhagen et al. |
| 2006/0275283 A1 | 12/2006 | Van Vlijmen et al. |
| 2008/0051563 A1 | 2/2008 | Lazar et al. |
| 2009/0053211 A9 | 2/2009 | Lazar et al. |
| 2009/0263392 A1 | 10/2009 | Igawa et al. |
| 2010/0015133 A1 | 1/2010 | Igawa et al. |
| 2010/0272723 A1 | 10/2010 | Bernett et al. |
| 2010/0286374 A1 | 11/2010 | Kannan et al. |
| 2010/0298542 A1 | 11/2010 | Igawa et al. |
| 2010/0331527 A1 | 12/2010 | Davis et al. |
| 2011/0287009 A1 | 11/2011 | Scheer et al. |
| 2011/0301331 A1 | 12/2011 | Glaser et al. |
| 2012/0065379 A1 | 3/2012 | Igawa et al. |
| 2012/0071634 A1 | 3/2012 | Igawa et al. |
| 2012/0149876 A1 | 6/2012 | Von Kreudenstein et al. |
| 2012/0244578 A1 | 9/2012 | Kannan et al. |
| 2014/0199294 A1 | 7/2014 | Mimoto et al. |
| 2015/0166636 A1 | 6/2015 | Igawa et al. |
| 2015/0166654 A1 | 6/2015 | Igawa et al. |
| 2015/0210763 A1 | 7/2015 | Kuramochi et al. |
| 2015/0274809 A1 | 10/2015 | Igawa et al. |
| 2015/0344570 A1 | 12/2015 | Igawa et al. |
| 2016/0159915 A1 | 6/2016 | Igawa et al. |
| 2016/0229915 A1 | 8/2016 | Igawa et al. |
| 2016/0304862 A1 | 10/2016 | Igawa et al. |
| 2017/0283483 A1 | 10/2017 | Igawa et al. |
| 2017/0342154 A1 | 11/2017 | Igawa et al. |
| 2017/0355756 A1* | 12/2017 | Julien .................... A61P 25/00 |
| 2018/0051307 A1 | 2/2018 | Igawa et al. |
| 2018/0155451 A1 | 6/2018 | Mimoto et al. |
| 2018/0185481 A1 | 7/2018 | Van Dijk et al. |
| 2019/0085082 A1 | 3/2019 | Bicknell et al. |
| 2019/0211081 A1 | 7/2019 | Igawa et al. |
| 2019/0241662 A1 | 8/2019 | Luo et al. |
| 2019/0359704 A1 | 11/2019 | Igawa et al. |
| 2020/0181257 A1 | 6/2020 | Kuramochi et al. |
| 2021/0047410 A1 | 2/2021 | Liu et al. |
| 2021/0180049 A1 | 6/2021 | Igawa et al. |
| 2022/0064264 A1 | 3/2022 | Igawa et al. |
| 2022/0242934 A1 | 8/2022 | Igawa et al. |
| 2022/0251225 A1 | 8/2022 | Igawa et al. |
| 2022/0267822 A1 | 8/2022 | Igawa et al. |
| 2023/0058982 A1 | 2/2023 | Katada et al. |
| 2023/0220083 A1 | 7/2023 | Igawa et al. |
| 2023/0257470 A1 | 8/2023 | Igawa et al. |
| 2023/0279099 A1 | 9/2023 | Igawa et al. |
| 2024/0158785 A1 | 5/2024 | Igawa et al. |

FOREIGN PATENT DOCUMENTS

| | | |
|---|---|---|
| CA | 2850035 A1 | 4/2013 |
| CA | 2931296 A1 | 6/2015 |
| CN | 1291198 A | 4/2001 |
| CN | 103827300 A | 5/2014 |
| CN | 104204204 A | 12/2014 |
| CN | 105102618 A | 11/2015 |
| CN | 105980557 A | 9/2016 |
| CN | 107207607 A | 9/2017 |
| CN | 105102618 B | 4/2018 |
| CN | 108473562 A | 8/2018 |
| CN | 109517059 A | 3/2019 |
| CN | 105980557 B | 4/2020 |
| CN | 112839960 A | 5/2021 |
| CN | 112996813 A | 6/2021 |
| CN | 108473562 B | 6/2022 |
| CN | 109517059 B | 3/2023 |
| CN | 117545779 A | 2/2024 |
| CN | 117616123 A | 2/2024 |
| CN | 112839960 B | 9/2024 |
| CN | 117616123 B | 11/2024 |
| EP | 1537878 A1 | 6/2005 |
| EP | 2196541 A1 | 6/2010 |
| EP | 2196541 B1 | 11/2012 |
| EP | 2728002 A1 | 5/2014 |
| EP | 2762493 A1 | 8/2014 |
| EP | 2857420 A1 | 4/2015 |
| EP | 2862875 A1 | 4/2015 |
| EP | 2940135 A1 | 11/2015 |
| EP | 3078744 A1 | 10/2016 |
| EP | 3586872 A1 | 1/2020 |
| EP | 2857420 B1 | 9/2020 |
| EP | 3738980 A1 | 11/2020 |
| EP | 2762493 B1 | 6/2021 |
| EP | 3835321 A | 6/2021 |
| EP | 4082570 A1 | 11/2022 |
| EP | 2862875 B1 | 9/2023 |
| EP | 4361176 A1 | 5/2024 |
| EP | 4361273 A1 | 5/2024 |
| JP | 2006524039 A | 10/2006 |
| JP | 2008505174 A | 2/2008 |
| JP | 2014504265 A | 2/2014 |
| JP | 2014509857 A | 4/2014 |
| JP | 2014528906 A | 10/2014 |
| JP | 5972915 B2 | 8/2016 |
| JP | 6167040 B2 | 7/2017 |
| JP | 6204350 B2 | 9/2017 |
| JP | 6433297 B2 | 12/2018 |
| JP | 2019503655 A | 2/2019 |
| JP | 2020040975 A | 3/2020 |
| JP | 2020073557 A | 5/2020 |
| JP | 6768800 B2 | 10/2020 |
| JP | 2021511812 A | 5/2021 |
| JP | 6931034 B2 | 9/2021 |
| JP | 7012104 B2 | 2/2022 |
| RU | 2006142852 A | 6/2008 |
| RU | 2007107909 A | 9/2008 |
| RU | 2398777 C2 | 9/2010 |
| TW | 201116625 A | 5/2011 |
| TW | I507525 B | 11/2015 |
| WO | WO9940117 A1 | 8/1999 |
| WO | WO0037504 A2 | 6/2000 |
| WO | WO0042072 A2 | 7/2000 |
| WO | WO0114424 A2 | 3/2001 |
| WO | WO2004004771 A1 | 1/2004 |
| WO | WO2004063351 A2 | 7/2004 |
| WO | WO2004099249 A2 | 11/2004 |

(56) References Cited

FOREIGN PATENT DOCUMENTS

| | | |
|---|---|---|
| WO | WO2005003298 A2 | 1/2005 |
| WO | WO2006015371 A2 | 2/2006 |
| WO | WO2006019447 A1 | 2/2006 |
| WO | WO2006036291 A2 | 4/2006 |
| WO | WO2006085938 A2 | 8/2006 |
| WO | WO2006088494 A2 | 8/2006 |
| WO | WO2006106905 A1 | 10/2006 |
| WO | WO2006133486 A1 | 12/2006 |
| WO | WO2007024249 A2 | 3/2007 |
| WO | WO2007114325 A1 | 10/2007 |
| WO | WO-2008068048 A2 * 6/2008 ............. A61P 31/10 |
| WO | WO2009041062 A1 | 4/2009 |
| WO | WO2009041613 A1 | 4/2009 |
| WO | WO2009062083 A2 | 5/2009 |
| WO | WO2010085682 A2 | 7/2010 |
| WO | WO2010107109 A1 | 9/2010 |
| WO | WO2010107110 A1 | 9/2010 |
| WO | WO2011107989 A1 | 9/2011 |
| WO | WO2012032080 A1 | 3/2012 |
| WO | WO2012058768 A1 | 5/2012 |
| WO | WO2012120125 A1 | 9/2012 |
| WO | WO2012125850 A1 | 9/2012 |
| WO | WO2013002362 A1 | 1/2013 |
| WO | WO2013046704 A2 | 4/2013 |
| WO | WO2013047748 A1 | 4/2013 |
| WO | WO2013063702 A1 | 5/2013 |
| WO | WO2013118858 A1 | 8/2013 |
| WO | WO2013180200 A1 | 12/2013 |
| WO | WO2013187495 A1 | 12/2013 |
| WO | WO2014104165 A1 | 7/2014 |
| WO | WO2014177459 A2 | 11/2014 |
| WO | WO2015083764 A1 | 6/2015 |
| WO | WO2016098356 A1 | 6/2016 |
| WO | WO2016196237 A1 | 12/2016 |
| WO | WO2017087588 A1 | 5/2017 |
| WO | WO2017104783 A1 | 6/2017 |
| WO | WO2018146317 A1 | 8/2018 |
| WO | WO2018155611 A1 | 8/2018 |
| WO | WO2018223182 A1 | 12/2018 |
| WO | WO2019148444 A1 | 8/2019 |
| WO | WO2019152413 A1 | 8/2019 |
| WO | WO2020014413 A2 | 1/2020 |
| WO | WO2020092155 A1 | 5/2020 |
| WO | WO2021131021 A1 | 7/2021 |
| WO | WO2022044248 A1 | 3/2022 |
| WO | WO2022045276 A1 | 3/2022 |
| WO | WO2022270611 A1 | 12/2022 |
| WO | WO2022270612 A1 | 12/2022 |

OTHER PUBLICATIONS

Chen et al., Enhancement and destruction of antibody function by somatic mutation: unequal occurrence is controlled by V gene combinatorial associations. EMBO J. Jun. 15, 1995;14(12):2784-94. (Year: 1995).*

Koenig et al., Mutational landscape of antibody variable domains reveals a switch modulating the interdomain conformational dynamics and antigen binding. PNAS Jan. 24, 2017 114 (4) E486-E495; first published Jan. 5, 2017; (Year: 2017).*

Kussie, Paul H., "A Single Engineered Amino Acid Substitution Changes Antibody Fine Specificity", 1994, Journal of Immunology 152(1): pp. 146-152. (Year: 1994).*

Contardi et al. "CTLA-4 is constitutively expressed on tumor cells and can trigger apoptosis upon ligand interaction". Int. J. Cancer: 117,pp. 538-550. (Year: 2005).*

Bjellqvist, B., et al., "The Focusing Positions of Polypeptides in Immobilized pH Gradients Can Be Predicted From Their Amino Acid Sequences," Electrophoresis, 14(10):1023-1031 (1993).

Brunet, J.F., et al., "A New Member of the Immunoglobulin Superfamily-CTLA-4," Nature, 328(6127):267-270 (1987).

Cartron, G., et al., "Therapeutic Activity of Humanized Anti-cCD20 Monoclonal Antibody and Polymorphism in IgG Fc Receptor FcgammaRIIIa Gene," Blood, 99(3):754-758 (2002).

Chen, X., et al., "FcγR-Binding Is an Important Functional Attribute for Immune Checkpoint Antibodies in Cancer Immunotherapy," Front Immunol., 10:292 (2019).

Chu, S.Y., et al., "Inhibition of B Cell Receptor-Mediated Activation of Primary Human B Cells by Coengagement of CD19 and FcgammaRIIb With Fc-engineered Antibodies," Molecular Immunology, 45(15):3926-3933 (2008).

Clark, R., "IgG Effector Mechanisms," Chemical Immunology, 65:88-110 (1997).

Clynes, R., et al., "Fc Receptors Are Required in Passive and Active Immunity to Melanoma," Proceedings of the National Academy of Sciences of the United States of America, 95(2):652-656 (1998).

Clynes, R.A., et al., "Inhibitory Fc Receptors Modulate in Vivo Cytotoxicity Against Tumor Targets," Nature Medicine, 6(4):443-446 (2000).

Davis, J.H., et al., "SEEDbodies: Fusion Proteins Based on Strand-exchange Engineered Domain (SEED) $C_H3$ Heterodimers in an Fc Analogue Platform for Asymmetric Binders or Immunofusions and Bispecific Antibodies," Protein Engineering, Design & Selection, 23(4):195-202 (2010).

Dondelinger, M., et al., "Understanding the Significance and Implications of Antibody Numbering and Antigen-Binding Surface/Residue Definition," Front Immunol., 9:2278 (2018).

Escobar-Cabrera, E., et al., "Asymmetric Fc Engineering for Bispecific Antibodies with Reduced Effector Function," Antibodies, 6:7 (2017).

Final Office Action dated Aug. 29, 2023 in U.S. Appl. No. 16/795,676, filed Feb. 20, 2020, Kuramochi et al.

Gonzales, N. R., et al., "Minimizing the Immunogenicity of Antibodies for Clinical Application," Tumor Biol., 26(1):31-43 (2005).

Greenwood, J., et al., "Structural Motifs Involved in Human IgG Antibody Effector Functions," European Journal of Immunology, 23(5):1098-1104 (1993).

Gunasekaran, K., et al., "Enhancing Antibody Fc Heterodimer Formation Through Electrostatic Steering Effects: Applications to Bispecific Molecules and Monovalent IgG," The Journal of Biological Chemistry, 285(25):19637-19646 (2010).

Ha, D., et al., "Differential Control of Human Treg and Effector T Cells in Tumor Immunity by Fc-engineered Anti-CTLA-4 Antibody," Proceedings of the National Academy of Sciences of the United States of America, 116(2):609-618 (2019).

Horton, H.M., et al., "Potent in Vitro and in Vivo Activity of an Fc-engineered Anti-CD19 Monoclonal Antibody Against Lymphoma and Leukemia," Cancer Research, 68(19):8049-8057 (2008).

Igawa, et al., "Antibody Optimization Technologies for Developing Next Generation Antibody Therapeutics", Bio Industry, 28(7):15-21 (2011).

Jefferis, R., et al., "Interaction Sites on Human IgG-fc for FcgammaR: Current Models," Immunology Letters, 82(1-2):57-65 (2002).

Kunik, V., et al., "Structural Consensus among Antibodies Defines the Antigen Binding Site," PLoS Comput Biol., 8(2):e1002388 (2012).

Kussie, P. H., et al., "A Single Engineered Amino Acid Substitution Changes Antibody Fine Specificity," J Immunol., 152:146-152 (1994).

Lazar, G.A., et al., "Engineered Antibody Fc Variants With Enhanced Effector Function," Proceedings of the National Academy of Sciences of the United States of America, 103(11):4005-4010 (2006).

Leach, D.R., et al., "Enhancement of Antitumor Immunity by CTLA-4 blockade," Science, 271(5256):1734-1736 (1996).

Liu, Z., et al., "Fine mapping of the antigen-antibody interaction of scFv215, a recombinant antibody inhibiting RNA polymerase II from *Drosophila melanogaster*," J Mol Recognit., 12(2):103-111 (1999).

Liu, Z., et al., "Asymmetrical Fc Engineering Greatly Enhances Antibody-dependent Cellular Cytotoxicity (ADCC) Effector Function and Stability of the Modified Antibodies," J Biol Chem., 289(6):3571-3590 (2014).

Marvin, J.S., et al., "Recombinant Approaches to Igg-like Bispecific Antibodies," Acta Pharmacologica Sinica, 26(6):649-658 (2005).

Meulenbroek, A.J. and Zeijlemaker, W. P., "Human IgG Subclasses: Useful diagnostic markers for Immunocompetence, 2.3 Properties of human IgG subclasses," Sanquin formerly CLB (Centraal Laboratorium van de Bloedtransfusiedienst) (2017).

(56) References Cited

OTHER PUBLICATIONS

Mimoto, F., et al., "Engineered Antibody Fc Variant With Selectively Enhanced FcγRIIb Binding Over Both FcγRIIa(R131) and FcγRIIa(H131)," Protein Engineering, Design & Selection, 26(10):589-598 (2013).
Mimoto, F., et al., "Crystal Structure of a Novel Asymmetrically Engineered Fc Variant with Improved Affinity for FcγRs," Molecular Immunology, 58(1):132-138 (2014).
Morgan, A., et al., "The N-Terminal End of the CH2 Domain of Chimeric Human IgG1 Anti-HLA-DR is Necessary for C1q, Fc Gamma RI and Fc Gamma RIII Binding," Immunology, 86(2):319-324 (1995).
Nezu, J., et al., "Chugai's Strategy for Drug Discovery Research," Chugai Pharmaceutical Co., Ltd. Presentation Dec. 9, 2019, pp. 1-80.
Nimmerjahn, F., et al., "Divergent Immunoglobulin G Subclass Activity Through Selective Fc Receptor Binding," Science, 310(5753):1510-1512 (2005).
Nishikawa, H., et al., "Regulatory T cells in Tumor Immunity," International Journal of Cancer, 127(4):759-767 (2010).
Office Action dated Jan. 31, 2023 in U.S. Appl. No. 16/795,676, filed Feb. 20, 2020, Kuramochi et al.
Okabe, H., "Proprietary Innovative Antibody Engineering Technologies in Chugai Pharmaceutical," Information Meeting on Antibody Engineering Technologies, pp. 78 (2012).
Panka, D. J., et al., "Variable region framework differences result in decreased or increased affinity of variant anti-digoxin antibodies," Proc Natl Acad Sci., 85:3080-3084 (1988).
Pardoll, D.M., et al., "The Blockade of Immune Checkpoints in Cancer Immunotherapy," Nature Reviews. Cancer, 12(4):252-264 (2012).
Pavlou, A.K. and Belsey, M.J, "The Therapeutic Antibodies Market to 2008," European Journal of Pharmaceutics and Biopharmaceutics, 59(3):389-396 (2005).
Radaev, S., et al., "The Structure of a Human Type III Fcgamma Receptor in Complex With Fc," The Journal of Biological Chemistry, 276(19):16469-16477 (2001).
Ramagopal, U. A., et al., "Structural basis for cancer immunotherapy by the first-in-class checkpoint inhibitor ipilimumab," PNAS, 114(21):E4223-E4232 (2017).
Reichert, J.M., et al., "Monoclonal Antibody Successes in the Clinic," Nature Biotechnology, 23(9):1073-1078 (2005).
Restriction Requirement dated Jul. 21, 2022, in U.S. Appl. No. 16/795,676, filed Feb. 20, 2020, Kuramochi et al.
Richards, J.O., et al., "Optimization of Antibody Binding to FcgammaRIIa Enhances Macrophage Phagocytosis of Tumor Cells," Molecular Cancer Therapeutics, 7(8):2517-2527 (2008).
Ridgway, J.B., et al., "Knobs-into-holes' Engineering of Antibody CH3 Domains for Heavy Chain Heterodimerization," Protein Engineering, 9(7):617-621 (1996).
Sakaguchi, S., et al., "Immunologic Self-tolerance Maintained by Activated T cells Expressing IL-2 Receptor Alpha-chains (CD25). Breakdown of a Single Mechanism of Self-Tolerance Causes Various Autoimmune Diseases," Journal of immunology, 155(3):1151-1164 (1995).
Samuelsson, A., et al., "Anti-Inflammatory Activity of IVIG Mediated Through the Inhibitory Fc Receptor," Science, 291(5503):484-486 (2001).
Sela-Culang, I., et al., "The structural basis of antibody-antigen recognition," Front Immunol. 4:302 (2013).
Shields, R. L., et al., "High Resolution Mapping of the Binding Site on Human IgG1 for Fc Gamma RI, Fc Gamma RIII, Fc Gamma RIII, and FcRn and Design of Igg1 Variants With Improved Binding to the Fc Gamma R," The Journal of Biological Chemistry, 276(9):6591-6604 (2001).
Shinkawa, T., et al., "The Absence of Fucose but Not the Presence of Galactose or Bisecting N-acetylglucosamine of Human IgG1 Complex-type Oligosaccharides Shows the Critical Role of Enhancing Antibody-dependent Cellular Cytotoxicity," The Journal of Biological Chemistry 278(5):3466-3473 (2003).
Takahashi, T., et al., "Immunologic Self-tolerance Maintained by CD25(+)CD4(+) Regulatory T Cells Constitutively Expressing Cytotoxic T Lymphocyte-associated Antigen 4," The Journal of Experimental Medicine, 192(2):303-310 (2000).
Tamura, K., et al., "FcγR2A and 3A Polymorphisms Predict Clinical Outcome of Trastuzumab in Both Neoadjuvant and Metastatic Settings in Patients with HER2-positive Breast Cancer," Annals of Oncology, 22(6):1302-1307 (2011).
Tsao, et al., "CD47 Blockade Augmentation of Trastuzumab Antitumor Efficacy Dependent on Antibody-dependent Cellular Phagocytosis," JCI Insight, 4(24):e131882 (2019).
Wark, K. L. and Hudson, P. J., "Latest technologies for the enhancement of antibody affinity," Adv Drug Del Rev., 58(5-6):657-670 (2006).
Warncke, M., et al., "Different Adaptations of IgG Effector Function in Human and Nonhuman Primates and Implications for Therapeutic Antibody Treatment," Journal of Immunology, 188(9):4405-4411 (2012).
Wong, Y. W., et al., "Structural Requirements for a Specificity Switch and for Maintenance of Affinity Using Mutational Analysis of a Phage-Displayed Anti-Arsonate Antibody of Fab Heavy Chain First Complementarity-Determining Region," J Immunol., 160:5990-5997 (1998).
Wu, H., et al., "Humanization of a Murine Monoclonal Antibody by Simultaneous Optimization of Framework and CDR Residues," J Mol Biol., 294:151-162 (1999).
Zalevsky, J., et al., "The Impact of Fc Engineering on an Anti-CD19 Antibody: Increased Fcgamma Receptor Affinity Enhances B-cell Clearing in Nonhuman Primates," Blood, 113(16):3735-3743 (2009).
Zhang, P., et al., "Mechanism- and Immune Landscape-Based Ranking of Therapeutic Responsiveness of 22 Major Human Cancers to Next Generation Anti-CTLA-4 Antibodies," Cancers, 12(2):284 (2020).
U.S. Appl. No. 09/483,588, filed Jan. 14, 2000, Presta.
U.S. Appl. No. 09/520, 130, filed Mar. 7, 2000, Arathoon et al.
U.S. Appl. No. 11/124,620, filed May 5, 2005, Lazar et al.
U.S. Appl. No. 11/271,140, filed Nov. 10, 2005, Stavenhagen.
U.S. Appl. No. 11/433,313, filed May 11, 2006, Van Vlijmen et al.
U.S. Appl. No. 11/841,821, filed Aug. 20, 2007, Lazar et al.
U.S. Appl. No. 11/910,128, filed Oct. 7, 2008, Igawa et al., related application.
U.S. Appl. No. 12/295,075, filed Apr. 20, 2009, Igawa et al., related application.
U.S. Appl. No. 12/377,251, filed Jul. 7, 2010, Bernett et al.
U.S. Appl. No. 12/680,082, filed Jun. 25, 2010, Igawa et al., related application.
U.S. Appl. No. 12/811,207, filed Jun. 29, 2010, Kannan et al.
U.S. Appl. No. 12/823,838, filed Jun. 25, 2010, Davis et al.
U.S. Appl. No. 13/257,112, filed Nov. 22, 2011, Igawa et al., related application.
U.S. Appl. No. 13/257,145, filed Nov. 22, 2011, Igawa et al., related application.
U.S. Appl. No. 13/289,934, filed Nov. 4, 2011, Von Kreudenstein et al.
U.S. Appl. No. 13/511,133, filed May 21, 2012, Kannan et al.
U.S. Appl. No. 14/127,576, filed Mar. 13, 2014, Mimoto et al., related application.
U.S. Appl. No. 14/377,556, filed Aug. 8, 2014, Kuramochi et al., related application.
U.S. Appl. No. 14/402,574, filed Nov. 20, 2014, Igawa et al., related application.
U.S. Appl. No. 14/406,232, filed Dec. 8, 2014, Igawa et al.
U.S. Appl. No. 14/654,895, filed Jun. 23, 2015, Igawa et al., related application.
U.S. Appl. No. 14/680,250, filed Apr. 7, 2015, Igawa et al., related application.
U.S. Appl. No. 14/962,293, filed Dec. 8, 2015, Igawa et al., related application.
U.S. Appl. No. 15/024,063, filed Mar. 23, 2016, Igawa et al.
U.S. Appl. No. 15/100,934, filed Jun. 1, 2016, Igawa et al., related application.
U.S. Appl. No. 15/490,936, filed Apr. 19, 2017, Igawa et al., related application.

(56) References Cited

OTHER PUBLICATIONS

U.S. Appl. No. 15/614,842, filed Jun. 6, 2017, Igawa et al., related application.
U.S. Appl. No. 15/782,256, filed Oct. 12, 2017, Igawa et al., related application.
U.S. Appl. No. 15/860,163, filed Jan. 2, 2018, Mimoto et al., related application.
U.S. Appl. No. 16/298,032, filed Mar. 11, 2019, Igawa et al., related application.
U.S. Appl. No. 16/539,765, filed Aug. 13, 2019, Igawa et al., related application.
U.S. Appl. No. 16/795,676, filed Feb. 20, 2020, Kuramochi et al., related application.
U.S. Appl. No. 17/182,331, filed Feb. 23, 2021, Igawa et al., related application.
U.S. Appl. No. 17/520,368, filed Nov. 5, 2021, Igawa et al., related application.
U.S. Appl. No. 17/530,542, filed Nov. 19, 2021, Igawa et al., related application.
U.S. Appl. No. 17/720,937, filed Apr. 14, 2022, Igawa et al., related application.
U.S. Appl. No. 17/788,998, filed Jun. 24, 2022, Katada et al., related application.
U.S. Appl. No. 18/022,342, filed Feb. 21, 2023, Katada et al., related application.
U.S. Appl. No. 18/023,038, filed Feb. 24, 2023, Katada et al., related application.
U.S. Appl. No. 18/052,258, filed Nov. 3, 2022, Igawa et al.
U.S. Appl. No. 18/138,888, filed Apr. 25, 2023, Igawa et al., related application.
U.S. Appl. No. 18/176,201, filed Feb. 28, 2023, Igawa et al., related application.
U.S. Appl. No. 18/298,743, filed Apr. 11, 2023, Igawa et al.
U.S. Appl. No. 18/411,929, filed Jan. 12, 2024, Igawa et al., related application.
U.S. Appl. No. 11/910,128, filed Oct. 7, 2008, Igawa et al.
U.S. Appl. No. 12/295,075, filed Apr. 20, 2009, Igawa et al.
U.S. Appl. No. 12/680,082, filed Jun. 25, 2010, Igawa et al.
U.S. Appl. No. 13/257,112, filed Nov. 22, 2011, Igawa et al.
U.S. Appl. No. 13/257,145, filed Nov. 22, 2011, Igawa et al.
U.S. Appl. No. 14/127,576, filed Mar. 13, 2014, Mimoto et al.
U.S. Appl. No. 14/377,556, filed Aug. 8, 2014, Kuramochi et al.
U.S. Appl. No. 14/402,574, filed Nov. 20, 2014, Igawa et al.
U.S. Appl. No. 14/654,895, filed Jun. 23, 2015, Igawa et al.
U.S. Appl. No. 14/680,250, filed Apr. 7, 2015, Igawa et al.
U.S. Appl. No. 14/962,293, filed Dec. 8, 2015, Igawa et al.
U.S. Appl. No. 15/100,934, filed Jun. 1, 2016, Igawa et al.
U.S. Appl. No. 15/490,936, filed Apr. 19, 2017, Igawa et al.
U.S. Appl. No. 15/614,842, filed Jun. 6, 2017, Igawa et al.
U.S. Appl. No. 15/782,256, filed Oct. 12, 2017, Igawa et al.
U.S. Appl. No. 15/860,163, filed Jan. 2, 2018, Mimoto et al.
U.S. Appl. No. 16/298,032, filed Mar. 11, 2019, Igawa et al.
U.S. Appl. No. 16/539,765, filed Aug. 13, 2019, Igawa et al.
U.S. Appl. No. 16/795,676, filed Feb. 20, 2020, Kuramochi et al.
U.S. Appl. No. 17/182,331, filed Feb. 23, 2021, Igawa et al.
U.S. Appl. No. 17/520,368, filed Nov. 5, 2021, Igawa et al.
U.S. Appl. No. 17/530,542, filed Nov. 19, 2021, Igawa et al.
U.S. Appl. No. 17/720,937, filed Apr. 14, 2022, Igawa et al.
U.S. Appl. No. 17/788,998, filed Jun. 24, 2022, Katada et al.
U.S. Appl. No. 18/022,342, filed Feb. 21, 2023, Katada et al.
U.S. Appl. No. 18/023,038, filed Feb. 24, 2023, Katada et al.
U.S. Appl. No. 18/138,888, filed Apr. 25, 2023, Igawa et al.
U.S. Appl. No. 18/176,201, filed Feb. 28, 2023, Igawa et al.
U.S. Appl. No. 18/411,929, filed Jan. 12, 2024, Igawa et al.
Blanco, B., et al., "T Cell-Redirecting Strategies to 'STAb' Tumors: Beyond CARs and Bispecific Antibodies," Trends Immunol., 40(3):243-257 (2019).
Chen, J., et al., "Advance in Research on Antibody Half-Life Related Engineering," China Biotechnology, 37(5):87-96, with English abstract (2017).
Information Meeting on Antibody Engineering Technologies, Chugai Pharmaceutical Co., Ltd., Dec. 18, 2012.
Mimoto, F., et al., "Novel asymmetrically engineered antibody Fc variant with superior FcγR binding affinity and specificity compared with afucosylated Fc variant," mAbs, 5(2):229-236 (2013).
Office Action dated May 8, 2024 in U.S. Appl. No. 16/795,676, filed Feb. 20, 2020, Kuramochi et al.
Pan, Y.-G., et al., "Research and application progress in intracellular single domain antibodies," Practical Pharmacy and Clinical Remedies, 4:457-463, with English abstract (2018).
Rudikoff, S., et al. "Single amino acid substitution altering antigen-binding specificity," Proc Natl Acad Sci 79:1979-1983 (1982).
Wang, X., et al., "IgG Fc engineering to modulate antibody effector functions," Protein Cell, 9(1):63-73 (2018).
Yang, C., et al., "Engineering of Fc Fragments with Optimized Physicochemical Properties Implying Improvement of Clinical Potentials for Fc-Based Therapeutics," Front Immunol., 8:1860 (2018).
Zhu, L., et al., "Study on the influence of CTLA4-Ig fusion protein glycosylation modification on its function," Chinese Journal of Pharmaceutical Analysis, 40(8):1391-1398, with English abstract (2020).
Ohta, A., "A Metabolic Immune Checkpoint: Adenosine in Tumor Microenvironment," Front Immunol., 7:109 (2016).
U.S. Appl. No. 17/484,003, filed Sep. 24, 2021, Igawa et al.

\* cited by examiner

FIG. 24

ANTI-CTLA-4 ANTIBODY AND USE THEREOF

CROSS-REFERENCE TO RELATED APPLICATIONS

This application claims the benefit of Japanese Patent Application No. 2021-105804, filed Jun. 25, 2021, and Japanese Patent Application No. 2021-105823, filed Jun. 25, 2021, each of which is incorporated herein by reference in its entirety.

Reference to Sequence Listing Submitted Electronically

The content of the electronically submitted sequence listing (Name: 6663_0217 Sequence_Listing.txt; Size: 798 KB; and Date of Creation: Jun. 24, 2022) filed with the application is incorporated herein by reference in its entirety.

TECHNICAL FIELD

The present invention relates to anti-CTLA-4 antibodies and methods of using the antibodies. The present invention also relates to polypeptides comprising a variant Fc region comprising an amino acid alteration(s) in a parent Fc region and methods of producing the polypeptides.

BACKGROUND ART

Cells that mutated due to gene mutations and such in living organisms are being monitored and eliminated by the immune surveillance system. However, persistence of excessive immune responses may become harmful also to the self, such as damage to normal tissues by autoimmunity. Thus, the immune system is provided with a negative feedback mechanism (immune checkpoints) for suppressing immune responses once activated (see, for example, NPL 1). Immune checkpoints are considered to play an important role in maintaining homeostasis in the immune system. On the other hand, it is being revealed that some tumors utilize immune checkpoints for immunological escape. Currently, studies on immunosuppressive function through main immune checkpoint molecules, cytotoxic T-lymphocyte-associated antigen 4 (CTLA-4), programmed cell death 1 (PD-1), and programmed cell death ligand 1 (PD-L1), are being widely pursued.

CTLA-4 is a glycoprotein belonging to the immunoglobulin superfamily, the gene of which was cloned from a cDNA library of killer T cell clones derived from mice in 1987 (see, for example, NPL 2). T cell immune response is known to be suppressed through CTLA-4. It was reported in 1996 that a tumor regression effect had been observed by administering an anti-CTLA-4 antibody to cancer-bearing mice based on the idea that promotion of T cell activation by suppressing the CTLA-4 function leads to cancer regression (see, for example, NPL 3). Evaluation of the efficacy of anti-CTLA-4 antibodies in humans has been conducted since 2000, and an anti-human CTLA-4 monoclonal antibody (ipilimumab) was approved by U.S. Food and Drug Administration (FDA) as the world's first immunostimulatory therapeutic antibody in 2011. Many anti-CTLA-4 monoclonal antibodies other than ipilimumab were also produced (see, for example, PTL 1, PTL 2, PTL 3, and PTL 4) and their developments as medicaments are being performed. Such drugs that inhibit immune checkpoints to cancel the immunosuppressive mechanism, thereby enhancing immunoreactivity are called immune checkpoint inhibitors.

On the other hand, it has been known before that there are some cells having an immunosuppressive function among T cells, and they were identified as CD25- and CD4-positive T cells in 1995 and named regulatory T cells (see, for example, NPL 4). In 2003, the Foxp3 gene was identified, which is a master gene that is specifically expressed in regulatory T cells and regulates their development and function. Foxp3 regulates expression of various immune response-associated genes as a transcription factor. Particularly, Foxp3 is involved in constitutive expression of CTLA-4 in regulatory T cells, and it is thought to play an important role in the immunosuppressive function by regulatory T cells (see, for example, NPL 5). Infiltration of regulatory T cells into tumor tissues is considered to lead to attenuation or inhibition of the immune surveillance mechanism against tumor. Indeed, it has been revealed that there are increased regulatory T cells in many human carcinomas (see, for example, NPL 6), and it has been reported that local infiltration of regulatory T cells into tumor may become a poor prognostic factor of a cancer patient. Conversely, if regulatory T cells can be removed from or decreased in tumor tissues, it is expected to lead to enhanced antitumor immunity. Currently, the development of cancer immunotherapy targeting regulatory T cells is vigorously progressing.

Administration of an anti-CTLA-4 antibody, ipilimumab, enhances antitumor immunity, but it has been reported to cause autoimmune diseases because it systemically enhances immunoreactivity. In a certain clinical trial, adverse events were observed in 60% of patients to which ipilimumab was administered, and many of them were autoimmune diseases associated with the skin or gastrointestinal tract. Also in another clinical trial, about half of patients to which ipilimumab was administered has been reported to develop similar autoimmune diseases. To suppress such side effects, in some cases, an immunosuppressive agent is administered to a patient to which ipilimumab has been administered. Development of a novel drug is desired that can maintain antitumor immune responses while suppressing such side effects of immune checkpoint inhibitors.

It is desirable that when a therapeutic antibody is administered to a living organism, its target antigen is specifically expressed only in the lesion sites. In many cases, however, the same antigen is expressed also in non-lesion sites, normal tissues, and it may cause side effects which are undesirable in terms of therapy. For example, although an antibody against a tumor antigen can exert cytotoxic activity against tumor cells by ADCC and such, when the same antigen is expressed in normal tissues as well, the antibody may also damage normal cells. To solve the above problem, a technology was developed which focuses on the phenomenon that a large amount of a particular compound is present in a target tissue (for example, a tumor tissue) and creates an antigen-binding molecule whose antigen-binding activity changes depending on the concentration of the compound (see, for example, PTL 11).

Antibodies are drawing attention as pharmaceuticals because of their high stability in the blood and less side effects (NPL 12 and NPL 13). Most of the currently marketed antibody pharmaceuticals are human IgG1 subclass antibodies. Many studies have so far been carried out on the effector functions of IgG class antibodies, namely, antibody-dependent cellular cytotoxicity (hereinafter denoted as ADCC) and complement-dependent cytotoxicity (hereinafter denoted as CDC). It has been reported that, among the human IgG class, IgG1 subclass antibodies have the highest ADCC activity and CDC activity (NPL 14). In addition, antibody-dependent cell-mediated phagocytosis (ADCP), which is phagocytosis of target cells mediated by IgG class antibodies, has also been shown as one of the antibody effector functions (NPL 15 and NPL 16).

In order for IgG antibodies to exert ADCC, CDC, and ADCP, the antibody Fc region needs to bind to an antibody receptor (hereinafter denoted as FcγR) present on the surface of effector cells such as killer cells, natural killer cells, and activated macrophages, and to various complement components. In humans, the FcγR protein family reportedly has isoforms FcγRIa, FcγRIIa, FcγRIIb, FcγRIIIa, and FcγRIIIb, and allotypes of each have also been reported (NPL 17).

Enhancement of cytotoxic effector functions such as ADCC, ADCP, and CDC is attracting attention as a promising means to strengthen the antitumor effect of antibodies. The importance of FcγR-mediated effector functions for the antitumor effect of antibodies has been reported using mouse models (NPL 7 and NPL 8). In addition, a correlation was observed between clinical results in humans and the FcγRIIIa high-affinity polymorphism allotype (V158) and low-affinity polymorphism allotype (F158) (NPL 18). Similarly, it has also been shown that clinical effects vary with FcγRIIa allotypes (H131 and R131) (NPL 19). These reports indicate that antibodies possessing an Fc region with optimized binding to a particular FcγR will mediate more potent effector functions and thereby exert effective antitumor effects.

The balance of binding activities of antibody toward the activating receptors constituted by FcγRIa, FcγRIIa, FcγRIIIa, and FcγRIIIb, and toward the inhibitory receptor constituted by FcγRIIb is an important element in optimizing the antibody effector functions. By using an Fc region with enhanced binding activity to activating receptors and reduced binding activity to inhibitory receptors, it may be possible to impart optimum effector functions to an antibody (NPL 20). For the binding between the Fc region and FcγRs, several amino acid residues within the antibody hinge region and CH2 domain, and the sugar chain attached to Asn at position 297 according to EU numbering, which is bound to the CH2 domain, have been shown to be important (NPL 14, NPL 21, and NPL 22). With a focus on this binding site, Fc region variants with various FcγR-binding properties have been studied so far, and Fc region variants with higher binding activity to activating FcγRs have been obtained (PTL 5, PTL 6, NPL 9, and NPL 10). For example, Lazar et al, substituted Ser at position 239, Ala at position 330, and Ile at position 332 according to EU numbering in human IgG1 with Asp, Leu, and Glu, respectively, and thereby successfully increased its binding to human FcγRIIIa (V158) up to about 370 times (NPL 9 and PTL 6). Shinkawa et al. succeeded in increasing the binding to FcγRIIIa up to about 100 times by deleting fucose in the sugar chain attached to Asn at EU numbering position 297 (NPL 23). These methods introduce the same alterations, or the same sugar chain modifications, into both of the two H chain Fc regions of an antibody. In the meantime, it has been reported that although the antibody Fc is a homodimer, it binds to FcγRs at 1:1, recognizing FcγRs asymmetrically via the lower hinge and the CH2 domain (NPL 11). In view of fact that the Fc region asymmetrically interacts with FcγRs, it may be possible to optimize the IgG-FcγR interaction more finely by introducing different modifications into each H chain. Based on this idea, methods for optimizing the antibody-FcγR interaction by modifying the Fc region of each H chain differently so that Fc is asymmetrically modified have also been reported (PTL 7, PTL 8, PTL 9, and PTL 10). In fact, asymmetrical modification of the Fc region yielded variants with higher ADCC activity than afucosylated antibodies, which are existing ADCC-enhanced antibodies (PTL 9 and PTL 10).

In addition to ADCC activity, ADCP activity is also an important effector function of antibody, and has been reported to contribute to antitumor effects (NPL 24). ADCP activity can be enhanced by inhibiting the "Don't eat me" signal, as represented by CD47 (NPL 24), and also be enhanced by strengthening the FcγRIIa-binding ability (NPL 25). However, FcγRIIa, an activating FcγR, and inhibitory FcγRIIb share a very high homology in the amino acid sequence of the extracellular region, and therefore selective enhancement of the FcγRIIa-binding ability is difficult (NPL 26). Accordingly, when the FcγRIIa-binding ability is enhanced, the binding activity to FcγRIIb, an inhibitory receptor, is also likely to be enhanced, thereby weakening the effector functions. In fact, variants with greatly improved FcγRIIa-binding ability also had stronger FcγRIIb-binding ability than native IgG1 (PTL 9 and PTL 10). Thus, in order to exhibit high ADCC/ADCP activity, it is preferable to enhance the binding to FcγRIIIa and/or FcγRIIa as much as possible without enhancing the binding to FcγRIIb; however, no such variant has been reported.

CITATION LIST

Patent Literature

[PTL 1] WO 2000/037504
[PTL 2] WO 2001/014424
[PTL 3] WO 2012/120125
[PTL 4] WO 2016/196237
[PTL 5] WO 2000/042072
[PTL 6] WO 2006/019447
[PTL 7] WO 2012/058768
[PTL 8] WO 2012/125850
[PTL 9] WO 2013/002362
[PTL 10] WO 2014/104165
[PTL 11] WO 2013/180200

Non-Patent Literature

[NPL 1] Pardoll, Nat Rev Cancer (2012) 12: 252-264
[NPL 2] Brunet et al., Nature (1987) 328: 267-270
[NPL 3] Leach et al., Science (1996) 271: 1734-1736
[NPL 4] Sakaguchi et al., J Immunol (1995) 155: 1151-1164
[NPL 5] Takahashi et al., J Exp Med (2000) 192: 303-310
[NPL 6] Nishikawa & Sakaguchi, Int J Cancer (2010) 127: 759-767
[NPL 7] Clynes et al., Proc Natl Acad Sci USA (1998) 95: 652-656
[NPL 8] Clynes et al., Nat Med (2000) 6: 443-446
[NPL 9] Lazar et al., Proc Natl Acad Sci USA (2006) 103: 4005-4010
[NPL 10] Chu et al., Mol Immunol (2008) 45: 3926-3933
[NPL 11] Radaev et al., J Biol Chem (2001) 276: 16469-16477
[NPL 12] Reichert et al., Nat Biotechnol (2005) 23: 1073-1078
[NPL 13] Pavlou & Belsey, Eur J Pharm Biopharm (2005) 59: 389-396
[NPL 14] Clark, Chem Immunol (1997) 65: 88-110
[NPL 15] Horton et al., Cancer Res (2008) 68: 8049-8057
[NPL 16] Zalevsky et al., Blood (2009) 113: 3735-3743
[NPL 17] Jefferis & Lund, Immunol Lett (2002) 82: 57-65

[NPL 18] Carton et al., Blood (2002) 99: 754-758
[NPL 19] Tamura et al., Ann Oncol (2011) 22: 1302-1307
[NPL 20] Nimmerjahn & Ravetch, Science (2005) 310: 1510-1512
[NPL 21] Greenwood et al., Eur J Immunol (1993) 23: 1098-1104
[NPL 22] Morgan et al., Immunology (1995) 86: 319-324
[NPL 23] Shinkawa et al., J Biol Chem (2003) 278: 3466-3473
[NPL 24] Tsao et al., JCI Insight (2019) 4: e131882
[NPL 25] Richards et al., Mol Cancer Ther (2008) 7: 2517-2527
[NPL 26] Mimoto et al., Protein Eng Des Sel (2013) 26: 589-598

SUMMARY OF INVENTION

Technical Problem

The present invention provides anti-CTLA-4 antibodies and methods of using the antibodies. The present invention also provides polypeptides comprising a variant Fc region and methods of producing the polypeptides.

Solution to Problem

More specifically, the present invention provides [A1] to [A26] below.

[A1] An anti-CTLA-4 antibody comprising:
(A) a variable region having a CTLA-4 binding activity that is dependent on the concentration of an adenosine-containing compound; and
(B) a variant Fc region comprising a plurality of amino acid alterations in a parent Fc region,
wherein the parent Fc region is composed of two polypeptide chains, and
wherein the variant Fc region comprises amino acid alterations at the following positions:
(i) positions 234, 235, 236, 239, 268, 270, 298, and 330 according to EU numbering in the first polypeptide of the parent Fc region; and
(ii) positions 270, 298, 326, 330, and 334 according to EU numbering in the second polypeptide of the parent Fc region.

[A2] The anti-CTLA-4 antibody of [A1], wherein the variable region has at least one feature selected from (a) to (i) below:
(a) a binding activity in the presence of 100 μM adenosine-containing compound is twice or more higher than that in the absence of the adenosine-containing compound;
(b) KD value in the presence of 100 μM adenosine-containing compound is $5 \times 10^{-7}$ M or less;
(c) KD value in the absence of the adenosine-containing compound is $1 \times 10^{-6}$ M or more;
(d) forming a ternary complex with the adenosine-containing compound and CTLA-4;
(e) binding to a region from the amino acid at position 97 to the amino acid at position 106 of the human CTLA-4 (extracellular domain, SEQ ID NO: 28);
(f) competing with ABAM004 (VH, SEQ ID NO: 10; and VL, SEQ ID NO: 11) for binding to CTLA-4;
(g) binding to the same epitope as that bound by ABAM004 (VH, SEQ ID NO: 10; and VL, SEQ ID NO: 11);
(h) showing cytotoxic activity against a CTLA-4-expressing cell; and
(i) binding to human- and mouse-derived CTLA-4.

[A3] The anti-CTLA-4 antibody of [A1] or [A2], wherein the antibody is a monoclonal antibody.

[A4] The anti-CTLA-4 antibody of any one of [A1] to [A3], wherein the antibody is a human antibody, humanized antibody, or chimeric antibody.

[A5] The anti-CTLA-4 antibody of any one of [A1] to [A4], wherein the antibody comprises: (a) HVR-H1 (SEQ ID NO: 223) comprising the amino acid sequence $SX_1TMN$, wherein $X_1$ is H, A, R, or K; (b) HVR-H2 (SEQ ID NO: 224) comprising the amino acid sequence $SISX_1X_2SX_3YIYYAX_4SVX_5G$, wherein $X_1$ is S or T, $X_2$ is R or Q, $X_3$ is G or H, $X_4$ is D, E, or R, and $X_5$ is K or R; and (c) HVR-H3 (SEQ ID NO: 225) comprising the amino acid sequence $YGX_1REDMLWVFDY$, wherein $X_1$ is K or A.

[A6] The anti-CTLA-4 antibody of [A5], which further comprises: (a) HVR-L1 (SEQ ID NO: 226) comprising the amino acid sequence $X_1GX_2STX_3VGDYX_4X_5VX_6$, wherein $X_1$ is T, D, Q, or E, $X_2$ is T or P, $X_3$ is D or G, $X_4$ is N or T, $X_5$ is Y or W, and $X_6$ is S or H; (b) HVR-L2 (SEQ ID NO: 227) comprising the amino acid sequence $X_1TX_2X_3KPX_4$, wherein $X_1$ is E, F, or Y, $X_2$ is S or I, $X_3$ is K or S, and $X_4$ is S, E, or K; and (c) HVR-L3 (SEQ ID NO: 228) comprising the amino acid sequence $X_1TYAAPLGPX_2$, wherein $X_1$ is S or Q and $X_2$ is M or T.

[A7] The anti-CTLA-4 antibody of [A5], which further comprises: heavy chain variable domain FR1 comprising the amino acid sequence of any one of SEQ ID NOs: 229 to 232; FR2 comprising the amino acid sequence of SEQ ID NO: 233; FR3 comprising the amino acid sequence of SEQ ID NO: 234; and FR4 comprising the amino acid sequence of SEQ ID NO: 235.

[A8] The anti-CTLA-4 antibody of [A6], which further comprises: light chain variable domain FR1 comprising the amino acid sequence of any one of SEQ ID NOs: 236 to 238; FR2 comprising the amino acid sequence of any one of SEQ ID NOs: 240 and 241; FR3 comprising the amino acid sequence of any one of SEQ ID NOs: 242 to 244; and FR4 comprising the amino acid sequence of any one of SEQ ID NOs: 245 and 246.

[A9] The anti-CTLA-4 antibody of any one of [A1] to [A4], which comprises: (a) a VH sequence having at least 95% sequence identity to the amino acid sequence of any one of SEQ ID NOs: 83 to 86, 98, and 135 to 141; (b) a VL sequence having at least 95% sequence identity to the amino acid sequence of any one of SEQ ID NOs: 88 to 95, 97, 99, 134, and 144 to 149; or (c) a VH sequence having the amino acid sequence of any one of SEQ ID NOs: 83 to 86, 98, and 135 to 141 and a VL sequence having the amino acid sequence of any one of SEQ ID NOs: 88 to 95, 97, 99, 134, and 144 to 149.

[A10] The anti-CTLA-4 antibody of [A9], which comprises:
(1) the VH sequence of SEQ ID NO: 98 and the VL sequence of SEQ ID NO: 99;
(2) the VH sequence of SEQ ID NO: 83 and the VL sequence of SEQ ID NO: 88;
(3) the VH sequence of SEQ ID NO: 83 and the VL sequence of SEQ ID NO: 89;
(4) the VH sequence of SEQ ID NO: 83 and the VL sequence of SEQ ID NO: 90;
(5) the VH sequence of SEQ ID NO: 83 and the VL sequence of SEQ ID NO: 91;
(6) the VH sequence of SEQ ID NO: 83 and the VL sequence of SEQ ID NO: 92;
(7) the VH sequence of SEQ ID NO: 83 and the VL sequence of SEQ ID NO: 93;

(8) the VH sequence of SEQ ID NO: 83 and the VL sequence of SEQ ID NO: 94;
(9) the VH sequence of SEQ ID NO: 83 and the VL sequence of SEQ ID NO: 97;
(10) the VH sequence of SEQ ID NO: 83 and the VL sequence of SEQ ID NO: 95;
(11) the VH sequence of SEQ ID NO: 84 and the VL sequence of SEQ ID NO: 97;
(12) the VH sequence of SEQ ID NO: 85 and the VL sequence of SEQ ID NO: 97;
(13) the VH sequence of SEQ ID NO: 86 and the VL sequence of SEQ ID NO: 97;
(14) the VH sequence of SEQ ID NO: 86 and the VL sequence of SEQ ID NO: 134;
(15) the VH sequence of SEQ ID NO: 136 and the VL sequence of SEQ ID NO: 97;
(16) the VH sequence of SEQ ID NO: 135 and the VL sequence of SEQ ID NO: 97;
(17) the VH sequence of SEQ ID NO: 136 and the VL sequence of SEQ ID NO: 95;
(18) the VH sequence of SEQ ID NO: 137 and the VL sequence of SEQ ID NO: 97;
(19) the VH sequence of SEQ ID NO: 138 and the VL sequence of SEQ ID NO: 97;
(20) the VH sequence of SEQ ID NO: 138 and the VL sequence of SEQ ID NO: 144;
(21) the VH sequence of SEQ ID NO: 138 and the VL sequence of SEQ ID NO: 145;
(22) the VH sequence of SEQ ID NO: 138 and the VL sequence of SEQ ID NO: 146;
(23) the VH sequence of SEQ ID NO: 139 and the VL sequence of SEQ ID NO: 146;
(24) the VH sequence of SEQ ID NO: 140 and the VL sequence of SEQ ID NO: 146;
(25) the VH sequence of SEQ ID NO: 141 and the VL sequence of SEQ ID NO: 146;
(26) the VH sequence of SEQ ID NO: 140 and the VL sequence of SEQ ID NO: 147;
(27) the VH sequence of SEQ ID NO: 141 and the VL sequence of SEQ ID NO: 147;
(28) the VH sequence of SEQ ID NO: 140 and the VL sequence of SEQ ID NO: 148;
(29) the VH sequence of SEQ ID NO: 141 and the VL sequence of SEQ ID NO: 148;
(30) the VH sequence of SEQ ID NO: 136 and the VL sequence of SEQ ID NO: 149;
(31) the first variable region comprising the VH sequence of SEQ ID NO: 140 and the VL sequence of SEQ ID NO: 146, and the second variable region comprising the VH sequence of SEQ ID NO: 141 and the VL sequence of SEQ ID NO: 146; or
(32) the first variable region comprising the VH sequence of SEQ ID NO: 140 and the VL sequence of SEQ ID NO: 147, and the second variable region comprising the VH sequence of SEQ ID NO: 141 and the VL sequence of SEQ ID NO: 147.

[A11] The anti-CTLA-4 antibody of any one of [A1] to [A10], which is a full-length IgG1 antibody.

[A12] The anti-CTLA-4 antibody of any one of [A1] to [A11], wherein the variant Fc region further comprises an amino acid alteration at position 332 according to EU numbering in the first polypeptide of the parent Fc region.

[A13] The anti-CTLA-4 antibody of any one of [A1] to [A12], wherein the variant Fc region further comprises an amino acid alteration at position 332 according to EU numbering in the second polypeptide of the parent Fc region.

[A14] The anti-CTLA-4 antibody of any one of [A1] to [A13], wherein the variant Fc region further comprises an amino acid alteration at position 236 according to EU numbering in the second polypeptide of the parent Fc region.

[A15] The anti-CTLA-4 antibody of any one of [A1] to [A14], wherein the variant Fc region further comprises amino acid alterations at positions 250 and 307 according to EU numbering in the first polypeptide of the parent Fc region.

[A16] The anti-CTLA-4 antibody of any one of [A1] to [A15], wherein the variant Fc region further comprises amino acid alterations at positions 250 and 307 according to EU numbering in the second polypeptide of the parent Fc region.

[A17] The anti-CTLA-4 antibody of any one of [A1] to [A16], wherein the variant Fc region further comprises at least one amino acid alteration selected from the following amino acid alterations:
  (i) Phe at position 234, Gln at position 235, Trp at position 236, Met at position 239, Val at position 250, Asp at position 268, Glu at position 270, Ala at position 298, Pro at position 307, Met at position 330, and Glu at position 332, according to EU numbering in the first polypeptide of the parent Fc region, and
  (ii) Ala at position 236, Val at position 250, Glu at position 270, Ala at position 298, Pro at position 307, Asp at position 326, Met at position 330, Glu at position 332, and Glu at position 334, according to EU numbering in the second polypeptide of the parent Fc region.

[A18] The anti-CTLA-4 antibody of any one of [A1] to [A17], wherein the variant Fc region further comprises any of the amino acid alterations of (a) to (f) below:
  (a) Lys at position 356 according to EU numbering in the first polypeptide of the parent Fc region and Glu at position 439 according to EU numbering in the second polypeptide of the parent Fc region,
  (b) Glu at position 439 according to EU numbering in the first polypeptide of the parent Fc region and Lys at position 356 according to EU numbering in the second polypeptide of the parent Fc region,
  (c) Trp at position 366 according to EU numbering in the first polypeptide of the parent Fc region and Ser at position 366, Ala at position 368, and Val at position 407 according to EU numbering in the second polypeptide of the parent Fc region,
  (d) Ser at position 366, Ala at position 368, and Val at position 407 according to EU numbering in the first polypeptide of the parent Fc region and Trp at position 366 according to EU numbering in the second polypeptide of the parent Fc region,
  (e) Cys at position 349 and Trp at position 366 according to EU numbering in the first polypeptide of the parent Fc region and Cys at position 356, Ser at position 366, Ala at position 368, and Val at position 407 according to EU numbering in the second polypeptide of the parent Fc region, and
  (f) Cys at position 356, Ser at position 366, Ala at position 368, and Val at position 407 according to EU numbering in the first polypeptide of the parent Fc region and Cys at position 349 and Trp at position 366 according to EU numbering in the second polypeptide of the parent Fc region.

[A19] The anti-CTLA-4 antibody of any one of [A1] to [A18], wherein the variant Fc region further comprises any of the amino acid alterations of (a) to (d) below in the first polypeptide and/or second polypeptide of the parent Fc region:

(a) Ala at position 434 according to EU numbering,
(b) Ala at position 434, Thr at position 436, Arg at position 438, and Glu at position 440 according to EU numbering,
(c) Leu at position 428, Ala at position 434, Thr at position 436, Arg at position 438, and Glu at position 440 according to EU numbering, and
(d) Leu at position 428, Ala at position 434, Arg at position 438, and Glu at position 440 according to EU numbering.

[A20] The anti-CTLA-4 antibody of any one of [A1] to [A19], which comprises a heavy chain constant region comprising the variant Fc region.

[A21] The anti-CTLA-4 antibody of [A20], wherein the heavy chain constant region comprises
(1) the first polypeptide of SEQ ID NO: 358 and the second polypeptide of SEQ ID NO: 359, or
(2) the first polypeptide of SEQ ID NO: 360 and the second polypeptide of SEQ ID NO: 361.

[A22] An anti-CTLA-4 antibody comprising:
(1) the first H chain polypeptide of SEQ ID NO: 335, the second H chain polypeptide of SEQ ID NO: 336, and the L chain polypeptides of SEQ ID NO: 161, or
(2) the first H chain polypeptide of SEQ ID NO: 337, the second H chain polypeptide of SEQ ID NO: 338, and the L chain polypeptides of SEQ ID NO: 161.

[A23] An isolated nucleic acid encoding the anti-CTLA-4 antibody of any one of [A1] to [A22].

[A24] A host cell comprising the nucleic acid of [A23].

[A25] A method of producing an anti-CTLA-4 antibody, comprising culturing the host cell of [A24] such that the anti-CTLA-4 antibody is produced.

[A26] A pharmaceutical formulation comprising the anti-CTLA-4 antibody of any one of [A1] to [A22] and a pharmaceutically acceptable carrier.

More specifically, the present invention provides [B1] to [B34] shown below:

[B1] An anti CTLA-4 antibody for use in treating a tumor, wherein the anti CTLA-4 antibody comprises:
(A) a variable region having a CTLA-binding activity that is dependent on the concentration of an adenosine-containing compound; and
(B) a variant Fc region comprising multiple amino acid alterations in a parent Fc region, wherein the parent Fc region is composed of two polypeptide chains and the variant Fc region comprises amino acid alterations at the following positions:
(i) positions 234, 235, 236, 239, 268, 270, 298, and 330 according to EU numbering in a first polypeptide of the parent Fc region; and
(ii) positions 270, 298, 326, 330, and 334 according to EU numbering in a second polypeptide of the parent Fc region.

[B2] The anti-CTLA-4 antibody for the use of [B1], wherein the tumor is a solid tumor into which regulatory T (Treg) cells are infiltrated.

[B3] An anti-CTLA-4 antibody for use in damaging cells, wherein the anti-CTLA-4 antibody comprises:
(A) a variable region having a CTLA-binding activity that is dependent on the concentration of an adenosine-containing compound; and
(B) a variant Fc region comprising multiple amino acid alterations in a parent Fc region, wherein the parent Fc region is composed of two polypeptide chains and the variant Fc region comprises amino acid alterations at the following positions:
(i) positions 234, 235, 236, 239, 268, 270, 298, and 330 according to EU numbering in a first polypeptide of the parent Fc region; and
(ii) positions 270, 298, 326, 330, and 334 according to EU numbering in a second polypeptide of the parent Fc region.

[B4] The anti-CTLA-4 antibody for the use of [B3], wherein the cells to be damaged are Treg cells.

[B5] The anti-CTLA-4 antibody for the use of [B3], wherein the cells are damaged by ADCC activity, CDC activity, or ADCP activity.

[B6] The anti-CTLA-4 antibody for the use of [B3] or [B4], wherein an immune is activated by damaging Treg cells.

[B7] The anti-CTLA-4 antibody for the use of [B1] or [B2], wherein the tumor is at least one selected from the group consisting of carcinoma, lymphoma, blastoma, sarcoma, and leukemia.

[B8] The anti-CTLA-4 antibody for the use of [B7], wherein the tumor is at least one selected from the group consisting of lung cancer, small cell lung cancer, non-small cell lung cancer, pulmonary adenocarcinoma, squamous cell carcinoma of the lung, large intestine cancer, rectal cancer, colon cancer, breast cancer, liver cancer, gastric cancer, pancreatic cancer, renal cancer, prostate cancer, ovarian cancer, thyroid cancer, cholangiocarcinoma, peritoneal cancer, mesothelioma, squamous cell carcinoma, cervical cancer, endometrial cancer, bladder cancer, esophageal cancer, head and neck cancer, nasopharyngeal cancer, salivary gland tumor, thymoma, skin cancer, basal cell tumor, melanoma, malignant melanoma, anal cancer, penile cancer, testicular cancer, Wilms' tumor, acute myeloid leukemia (including acute myeloleukemia, acute myeloblastic leukemia, acute promyelocytic leukemia, acute myelomonocytic leukemia, and acute monocytic leukemia), chronic myelogenous leukemia, acute lymphoblastic leukemia, chronic lymphatic leukemia, Hodgkin's lymphoma, non-Hodgkin's lymphoma (including Burkitt's lymphoma, chronic lymphocytic leukemia, mycosis fungoides, mantle cell lymphoma, follicular lymphoma, diffuse large-cell lymphoma, marginal zone lymphoma, pilocytic leukemia plasmacytoma, peripheral T-cell lymphoma, and adult T cell leukemia/lymphoma), Langerhans cell histiocytosis, multiple myeloma, myelodysplastic syndrome, brain tumor (including glioma, astroglioma, glioblastoma, meningioma, and ependymoma), neuroblastoma, retinoblastoma, osteosarcoma, Kaposi's sarcoma, Ewing's sarcoma, angiosarcoma, and hemangiopericytoma.

[B9] The anti-CTLA-4 antibody for the use of [B8], wherein the tumor is at least one selected from the group consisting of lung cancer, large intestine cancer, colon cancer, breast cancer, liver cancer, pancreatic cancer, renal cancer, bladder cancer, head and neck cancer, and melanoma.

[B10] The anti-CTLA-4 antibody for the use of any one of [B1] to [B9], wherein the anti-CTLA-4 antibody is an immunoconjugate.

[B11] The anti-CTLA-4 antibody for the use of any one of [B1] to [B10], wherein the anti-CTLA-4 antibody is mixed and used with one or more any pharmaceutically acceptable carriers.

[B12] The anti-CTLA-4 antibody for the use of any one of [B1] to [B11], wherein the anti-CTLA-4 antibody is used in combination with at least one additional therapeutic agent.

[B13] The anti-CTLA-4 antibody for the use of [B12], wherein the additional therapeutic agent is at least one selected from the group consisting of an immune checkpoint inhibitor, an EGFR inhibitor, a HER2 inhibitor, and a chemotherapeutic agent.

[B14] The anti-CTLA-4 antibody for the use of any one of [B1] to [B13], wherein the variable region has at least one feature selected from (a) to (i) below:
(a) a binding activity in the presence of 100 μM adenosine-containing compound is twice or more higher than that in the absence of the adenosine-containing compound;
(b) KD value in the presence of 100 μM adenosine-containing compound is $5\times10^{-7}$ M or less;
(c) KD value in the absence of the adenosine-containing compound is $1\times10^{-6}$ M or more;
(d) forming a ternary complex with the adenosine-containing compound and CTLA-4;
(e) binding to a region from the amino acid at position 97 to the amino acid at position 106 of the human CTLA-4 (extracellular domain, SEQ ID NO: 28);
(f) competing with ABAM004 (VH, SEQ ID NO: 10; and VL, SEQ ID NO: 11) for binding to CTLA-4;
(g) binding to the same epitope as that bound by ABAM004 (VH, SEQ ID NO: 10; and VL, SEQ ID NO: 11);
(h) showing cytotoxic activity against a CTLA-4-expressing cell; and
(i) binding to human- and mouse-derived CTLA-4.

[B15] The anti-CTLA-4 antibody for the use of any one of [B1] to [B14], wherein the anti-CTLA-4 antibody is a monoclonal antibody.

[B16] The anti-CTLA-4 antibody for the use of any one of [B1] to [B15], wherein the anti-CTLA-4 antibody is a human antibody, humanized antibody, or chimeric antibody.

[B17] The anti-CTLA-4 antibody for the use of any one of [B1] to [B16], wherein the anti-CTLA-4 antibody comprises: (a) HVR-H1 (SEQ ID NO: 223) comprising the amino acid sequence $SX_1TMN$, wherein $X_1$ is H, A, R, or K; (b) HVR-H2 (SEQ ID NO: 224) comprising the amino acid sequence $SISX_1X_2SX_3YIYYAX_4SVX_5G$, wherein $X_1$ is S or T, $X_2$ is R or Q, $X_3$ is G or H, $X_4$ is D, E, or R, and $X_5$ is K or R; and (c) HVR-H3 (SEQ ID NO: 225) comprising the amino acid sequence $YGX_1REDMLWVFDY$, wherein $X_1$ is K or A.

[B18] The anti-CTLA-4 antibody for the use of [B17], wherein the anti-CTLA-4 antibody further comprises: (a) HVR-L1 (SEQ ID NO: 226) comprising the amino acid sequence $X_1GX_2STX_3VGDYX_4X_5VX_6$, wherein $X_1$ is T, D, Q, or E, $X_2$ is T or P, $X_3$ is D or G, $X_4$ is N or T, $X_5$ is Y or W, and $X_6$ is S or H; (b) HVR-L2 (SEQ ID NO: 227) comprising the amino acid sequence $X_1TX_2X_3KPX_4$, wherein $X_1$ is E, F, or Y, $X_2$ is S or I, $X_3$ is K or S, and $X_4$ is S, E, or K; and (c) HVR-L3 (SEQ ID NO: 228) comprising the amino acid sequence $X_1TYAAPLGPX_2$, wherein $X_1$ is S or Q and $X_2$ is M or T.

[B19] The anti-CTLA-4 antibody for the use of [B17], wherein the anti-CTLA-4 antibody further comprises: heavy chain variable domain FR1 comprising the amino acid sequence of any one of SEQ ID NOs: 229 to 232; FR2 comprising the amino acid sequence of SEQ ID NO: 233; FR3 comprising the amino acid sequence of SEQ ID NO: 234; and FR4 comprising the amino acid sequence of SEQ ID NO: 235.

[B20] The anti-CTLA-4 antibody for the use of [B18], wherein the anti-CTLA-4 antibody further comprises: light chain variable domain FR1 comprising the amino acid sequence of any one of SEQ ID NOs: 236 to 238; FR2 comprising the amino acid sequence of any one of SEQ ID NOs: 240 and 241; FR3 comprising the amino acid sequence of any one of SEQ ID NOs: 242 to 244; and FR4 comprising the amino acid sequence of any one of SEQ ID NOs: 245 and 246.

[B21] The anti-CTLA-4 antibody for the use of any one of [B1] to [B16], wherein the anti-CTLA-4 antibody comprises: (a) a VH sequence having at least 95% sequence identity to the amino acid sequence of any one of SEQ ID NOs: 83 to 86, 98, and 135 to 141; (b) a VL sequence having at least 95% sequence identity to the amino acid sequence of any one of SEQ ID NOs: 88 to 95, 97, 99, 134, and 144 to 149; or (c) a VH sequence having the amino acid sequence of any one of SEQ ID NOs: 83 to 86, 98, and 135 to 141 and a VL sequence having the amino acid sequence of any one of SEQ ID NOs: 88 to 95, 97, 99, 134, and 144 to 149.

[B22] The anti-CTLA-4 antibody for the use of [B21], wherein the anti-CTLA-4 antibody comprises:
(1) the VH sequence of SEQ ID NO: 98 and the VL sequence of SEQ ID NO: 99;
(2) the VH sequence of SEQ ID NO: 83 and the VL sequence of SEQ ID NO: 88;
(3) the VH sequence of SEQ ID NO: 83 and the VL sequence of SEQ ID NO: 89;
(4) the VH sequence of SEQ ID NO: 83 and the VL sequence of SEQ ID NO: 90;
(5) the VH sequence of SEQ ID NO: 83 and the VL sequence of SEQ ID NO: 91;
(6) the VH sequence of SEQ ID NO: 83 and the VL sequence of SEQ ID NO: 92;
(7) the VH sequence of SEQ ID NO: 83 and the VL sequence of SEQ ID NO: 93;
(8) the VH sequence of SEQ ID NO: 83 and the VL sequence of SEQ ID NO: 94;
(9) the VH sequence of SEQ ID NO: 83 and the VL sequence of SEQ ID NO: 97;
(10) the VH sequence of SEQ ID NO: 83 and the VL sequence of SEQ ID NO: 95;
(11) the VH sequence of SEQ ID NO: 84 and the VL sequence of SEQ ID NO: 97;
(12) the VH sequence of SEQ ID NO: 85 and the VL sequence of SEQ ID NO: 97;
(13) the VH sequence of SEQ ID NO: 86 and the VL sequence of SEQ ID NO: 97;
(14) the VH sequence of SEQ ID NO: 86 and the VL sequence of SEQ ID NO: 134;
(15) the VH sequence of SEQ ID NO: 136 and the VL sequence of SEQ ID NO: 97;
(16) the VH sequence of SEQ ID NO: 135 and the VL sequence of SEQ ID NO: 97;
(17) the VH sequence of SEQ ID NO: 136 and the VL sequence of SEQ ID NO: 95;
(18) the VH sequence of SEQ ID NO: 137 and the VL sequence of SEQ ID NO: 97;
(19) the VH sequence of SEQ ID NO: 138 and the VL sequence of SEQ ID NO: 97;
(20) the VH sequence of SEQ ID NO: 138 and the VL sequence of SEQ ID NO: 144;
(21) the VH sequence of SEQ ID NO: 138 and the VL sequence of SEQ ID NO: 145;
(22) the VH sequence of SEQ ID NO: 138 and the VL sequence of SEQ ID NO: 146;
(23) the VH sequence of SEQ ID NO: 139 and the VL sequence of SEQ ID NO: 146;
(24) the VH sequence of SEQ ID NO: 140 and the VL sequence of SEQ ID NO: 146;
(25) the VH sequence of SEQ ID NO: 141 and the VL sequence of SEQ ID NO: 146;

(26) the VH sequence of SEQ ID NO: 140 and the VL sequence of SEQ ID NO: 147;
(27) the VH sequence of SEQ ID NO: 141 and the VL sequence of SEQ ID NO: 147;
(28) the VH sequence of SEQ ID NO: 140 and the VL sequence of SEQ ID NO: 148;
(29) the VH sequence of SEQ ID NO: 141 and the VL sequence of SEQ ID NO: 148;
(30) the VH sequence of SEQ ID NO: 136 and the VL sequence of SEQ ID NO: 149;
(31) the first variable region comprising the VH sequence of SEQ ID NO: 140 and the VL sequence of SEQ ID NO: 146, and the second variable region comprising the VH sequence of SEQ ID NO: 141 and the VL sequence of SEQ ID NO: 146; or
(32) the first variable region comprising the VH sequence of SEQ ID NO: 140 and the VL sequence of SEQ ID NO: 147, and the second variable region comprising the VH sequence of SEQ ID NO: 141 and the VL sequence of SEQ ID NO: 147.

[B23] The anti-CTLA-4 antibody for the use of any one of [B1] to [B22], wherein the anti-CTLA-4 antibody is a full-length IgG1 antibody.

[B24] The anti-CTLA-4 antibody for the use of any one of [B1] to [B23], wherein the variant Fc region further comprises an amino acid alteration at position 332 according to EU numbering in the first polypeptide of the parent Fc region.

[B25] The anti-CTLA-4 antibody for the use of any one of [B1] to [B24], wherein the variant Fc region further comprises an amino acid alteration at position 332 according to EU numbering in the second polypeptide of the parent Fc region.

[B26] The anti-CTLA-4 antibody for the use of any one of [B1] to [B25], wherein the variant Fc region further comprises an amino acid alteration at position 236 according to EU numbering in the second polypeptide of the parent Fc region.

[B27] The anti-CTLA-4 antibody for the use of any one of [B1] to [B26], wherein the variant Fc region further comprises amino acid alterations at positions 250 and 307 according to EU numbering in the first polypeptide of the parent Fc region.

[B28] The anti-CTLA-4 antibody for the use of any one of [B1] to [B27], wherein the variant Fc region further comprises amino acid alterations at positions 250 and 307 according to EU numbering in the second polypeptide of the parent Fc region.

[B29] The anti-CTLA-4 antibody for the use of any one of [B1] to [B28], wherein the variant Fc region further comprises at least one amino acid alteration selected from the following amino acid alterations:
(i) Phe at position 234, Gln at position 235, Trp at position 236, Met at position 239, Val at position 250, Asp at position 268, Glu at position 270, Ala at position 298, Pro at position 307, Met at position 330, and Glu at position 332, according to EU numbering in the first polypeptide of the parent Fc region, and
(ii) Ala at position 236, Val at position 250, Glu at position 270, Ala at position 298, Pro at position 307, Asp at position 326, Met at position 330, Glu at position 332, and Glu at position 334, according to EU numbering in the second polypeptide of the parent Fc region.

[B30] The anti-CTLA-4 antibody for the use of any one of [B1] to [B29], wherein the variant Fc region further comprises any of the amino acid alterations of (a) to (f) below:
(a) Lys at position 356 according to EU numbering in the first polypeptide of the parent Fc region and Glu at position 439 according to EU numbering in the second polypeptide of the parent Fc region,
(b) Glu at position 439 according to EU numbering in the first polypeptide of the parent Fc region and Lys at position 356 according to EU numbering in the second polypeptide of the parent Fc region,
(c) Trp at position 366 according to EU numbering in the first polypeptide of the parent Fc region and Ser at position 366, Ala at position 368, and Val at position 407 according to EU numbering in the second polypeptide of the parent Fc region,
(d) Ser at position 366, Ala at position 368, and Val at position 407 according to EU numbering in the first polypeptide of the parent Fc region and Trp at position 366 according to EU numbering in the second polypeptide of the parent Fc region,
(e) Cys at position 349 and Trp at position 366 according to EU numbering in the first polypeptide of the parent Fc region and Cys at position 356, Ser at position 366, Ala at position 368, and Val at position 407 according to EU numbering in the second polypeptide of the parent Fc region, and
(f) Cys at position 356, Ser at position 366, Ala at position 368, and Val at position 407 according to EU numbering in the first polypeptide of the parent Fc region and Cys at position 349 and Trp at position 366 according to EU numbering in the second polypeptide of the parent Fc region.

[B31] The anti-CTLA-4 antibody for the use of any one of [B1] to [B30], wherein the variant Fc region further comprises any of the amino acid alterations of (a) to (d) below in the first polypeptide and/or second polypeptide of the parent Fc region:
(a) Ala at position 434 according to EU numbering,
(b) Ala at position 434, Thr at position 436, Arg at position 438, and Glu at position 440 according to EU numbering,
(c) Leu at position 428, Ala at position 434, Thr at position 436, Arg at position 438, and Glu at position 440 according to EU numbering, and
(d) Leu at position 428, Ala at position 434, Arg at position 438, and Glu at position 440 according to EU numbering.

[B32] The anti-CTLA-4 antibody for the use of any one of [B1] to [B31], which comprises a heavy chain constant region comprising the variant Fc region.

[B33] The anti-CTLA-4 antibody for the use of [B32], wherein the heavy chain constant region comprises
(1) the first polypeptide of SEQ ID NO: 383 and the second polypeptide of SEQ ID NO: 384, or
(2) the first polypeptide of SEQ ID NO: 376 and the second polypeptide of SEQ ID NO: 377.

[B34] An anti-CTLA-4 antibody for use in treating a tumor, wherein the anti-CTLA-4 antibody comprises:
(1) a first H chain polypeptide of SEQ ID NO: 385, a second H chain polypeptide of SEQ ID NO: 386, and an L chain polypeptide of SEQ ID NO: 161; or
(2) a first H chain polypeptide of SEQ ID NO: 368, a second H chain polypeptide of SEQ ID NO: 369, and an L chain polypeptide of SEQ ID NO: 161.

In one non-limiting embodiment, the present disclosure provides the following:

[101] A polypeptide which comprises a variant Fc region comprising amino acid alterations in a parent Fc region, wherein the parent Fc region is composed of two polypeptide chains, and wherein the variant Fc region comprises amino acid alterations at the following positions:
(i) positions 234, 235, 236, 239, 268, 270, and 298 according to EU numbering in the first polypeptide of the parent Fc region; and
(ii) positions 270, 298, 326, and 334 according to EU numbering in the second polypeptide of the parent Fc region.

[102] The polypeptide of [101], wherein the variant Fc region further comprises an amino acid alteration at position 326 according to EU numbering in the first polypeptide of the parent Fc region.

[103] The polypeptide of [101] or [102], wherein the variant Fc region further comprises an amino acid alteration at position 236 according to EU numbering in the second polypeptide of the parent Fc region.

[104] A polypeptide which comprises a variant Fc region comprising amino acid alterations in a parent Fc region, wherein the parent Fc region is composed of two polypeptide chains, and wherein the variant Fc region comprises amino acid alterations at the following positions:
(i) positions 234, 235, 236, 239, 268, 270, 298, and 326 according to EU numbering in the first polypeptide of the parent Fc region; and
(ii) positions 236, 270, 298, 326, and 334 according to EU numbering in the second polypeptide of the parent Fc region.

[105] The polypeptide of any one of [101] to [104], wherein the variant Fc region further comprises an amino acid alteration at position 332 according to EU numbering in the first polypeptide of the parent Fc region.

[106] The polypeptide of any one of [101] to [105], wherein the variant Fc region further comprises an amino acid alteration at position 330 according to EU numbering in the first polypeptide of the parent Fc region.

[107] The polypeptide of any one of [101] to [106], wherein the variant Fc region further comprises an amino acid alteration at position 332 according to EU numbering in the second polypeptide of the parent Fc region.

[108] The polypeptide of any one of [101] to [107], wherein the variant Fc region further comprises an amino acid alteration at position 330 according to EU numbering in the second polypeptide of the parent Fc region.

[109] A polypeptide which comprises a variant Fc region comprising amino acid alterations in a parent Fc region, wherein the parent Fc region is composed of two polypeptide chains, and wherein the variant Fc region comprises amino acid alterations at the following positions:
(i) positions 234, 235, 236, 239, 268, 270, 298, 330, and 332 according to EU numbering in the first polypeptide of the parent Fc region; and
(ii) positions 236, 270, 298, 326, 330, 332, and 334 according to EU numbering in the second polypeptide of the parent Fc region.

[110] The polypeptide of any one of [101] to [109], wherein the variant Fc region further comprises amino acid alterations at positions 250 and 307 according to EU numbering in the first polypeptide of the parent Fc region.

[111] The polypeptide of any one of [101] to [110], wherein the variant Fc region further comprises amino acid alterations at positions 250 and 307 according to EU numbering in the second polypeptide of the parent Fc region.

[112] A polypeptide which comprises a variant Fc region comprising amino acid alterations in a parent Fc region, wherein the parent Fc region is composed of two polypeptide chains, and wherein the variant Fc region comprises amino acid alterations at the following positions:
(i) positions 234, 235, 236, 239, 250, 268, 270, 298, and 307 according to EU numbering in the first polypeptide of the parent Fc region; and
(ii) positions 250, 270, 298, 307, 326, and 334 according to EU numbering in the second polypeptide of the parent Fc region.

[113] A polypeptide which comprises a variant Fc region comprising amino acid alterations in a parent Fc region, wherein the parent Fc region is composed of two polypeptide chains, and wherein the variant Fc region comprises amino acid alterations at the following positions:
(i) positions 234, 235, 236, 239, 250, 268, 270, 298, 307, and 326 according to EU numbering in the first polypeptide of the parent Fc region; and
(ii) positions 236, 250, 270, 298, 307, 326, and 334 according to EU numbering in the second polypeptide of the parent Fc region.

[114] A polypeptide which comprises a variant Fc region comprising amino acid alterations in a parent Fc region, wherein the parent Fc region is composed of two polypeptide chains, and wherein the variant Fc region comprises amino acid alterations at the following positions:
(i) positions 234, 235, 236, 239, 250, 268, 270, 298, 307, 330, and 332 according to EU numbering in the first polypeptide of the parent Fc region; and
(ii) positions 236, 250, 270, 298, 307, 326, 330, 332, and 334 according to EU numbering in the second polypeptide of the parent Fc region.

[115] The polypeptide of any one of [101] to [114], which comprises at least one amino acid alteration selected from the following amino acid alterations:
(i) Tyr or Phe at position 234, Gln or Tyr at position 235, Trp at position 236, Met at position 239, Val at position 250, Asp at position 268, Glu at position 270, Ala at position 298, Pro at position 307, Asp at position 326, Met at position 330, and Glu at position 332 according to EU numbering in the first polypeptide of the parent Fc region; and
(ii) Ala at position 236, Val at position 250, Glu at position 270, Ala at position 298, Pro at position 307, Asp at position 326, Met or Lys at position 330, Asp or Glu at position 332, and Glu at position 334 according to EU numbering in the second polypeptide of the parent Fc region.

[116] The polypeptide of any one of [101] to [115], wherein the variant Fc region further comprises any of the amino acid alterations of (a) to (f) below:
(a) Lys at position 356 according to EU numbering in the first polypeptide of the parent Fc region, and Glu at position 439 according to EU numbering in the second polypeptide of the parent Fc region;
(b) Glu at position 439 according to EU numbering in the first polypeptide of the parent Fc region, and Lys at position 356 according to EU numbering in the second polypeptide of the parent Fc region;
(c) Trp at position 366 according to EU numbering in the first polypeptide of the parent Fc region, and Ser at position 366, Ala at position 368, and Val at position 407 according to EU numbering in the second polypeptide of the parent Fc region;
(d) Ser at position 366, Ala at position 368, and Val at position 407 according to EU numbering in the first polypeptide of the parent Fc region, and Trp at position 366 according to EU numbering in the second polypeptide of the parent Fc region;
(e) Cys at position 349 and Trp at position 366 according to EU numbering in the first polypeptide of the parent Fc region, and Cys at position 356, Ser at position 366, Ala at position 368, and Val at position 407 according to EU numbering in the second polypeptide of the parent Fc region;

(f) Cys at position 356, Ser at position 366, Ala at position 368, and Val at position 407 according to EU numbering in the first polypeptide of the parent Fc region, and Cys at position 349 and Trp at position 366 according to EU numbering in the second polypeptide of the parent Fc region.

[117] The polypeptide of any one of [101] to [116], wherein the variant Fc region further comprises any of the amino acid alterations of (a) to (d) below in the first polypeptide and/or the second polypeptide of the parent Fc region:

(a) Ala at position 434 according to EU numbering;
(b) Ala at position 434, Thr at position 436, Arg at position 438, and Glu at position 440 according to EU numbering;
(c) Leu at position 428, Ala at position 434, Thr at position 436, Arg at position 438, and Glu at position 440 according to EU numbering; and
(d) Leu at position 428, Ala at position 434, Arg at position 438, and Glu at position 440 according to EU numbering.

[118] The polypeptide of any one of [101] to [117], wherein binding activity to at least one Fcγ receptor selected from the group consisting of FcγRIa, FcγRIIa, FcγRIIb, and FcγRIIIa is enhanced in the variant Fc region as compared to the parent Fc region.

[119] The polypeptide of [118], wherein binding activity to FcγRIIa and FcγRIIIa is enhanced in the variant Fc region as compared to the parent Fc region.

[120] The polypeptide of any one of [101] to [119], wherein selectivity between an activating Fcγ receptor and an inhibitory Fcγ receptor is improved in the variant Fc region as compared to the parent Fc region.

[120-2] The polypeptide of any one of [101] to [119], wherein binding activity to an activating Fcγ receptor is selectively enhanced as compared to binding activity to an inhibitory Fcγ receptor in the variant Fc region, as compared to the parent Fc region.

[120-3] The polypeptide of any one of [101] to [119], wherein a ratio of binding activity to an activating Fcγ receptor to binding activity to an inhibitory Fcγ receptor (A/I ratio) is higher in the variant Fc region than the parent Fc region.

[120-4] The polypeptide of [120-3], wherein the ratio (A/I ratio) in the polypeptide comprising the variant Fc region is 1.1 times or more, 1.2 times or more, 1.3 times or more, 1.4 times or more, 1.5 times or more, 1.6 times or more, 1.7 times or more, 1.8 times or more, 1.9 times or more, 2 times or more, 3 times or more, 4 times or more, 5 times or more, 6 times or more, 7 times or more, 8 times or more, 9 times or more, 10 times or more, 20 times or more, 30 times or more, 40 times or more, 50 times or more, 60 times or more, 70 times or more, 80 times or more, 90 times or more, 100 times or more, 200 times or more, 300 times or more, 400 times or more, 500 times or more, 600 times or more, 700 times or more, 800 times or more, 900 times or more, 1000 times or more, 2000 times or more, 3000 times or more, 4000 times or more, 5000 times or more, 6000 times or more, 7000 times or more, 8000 times or more, 9000 times or more, or 10000 times or more higher than that in a polypeptide comprising the parent Fc region.

[120-5] The polypeptide of [120-3], wherein the ratio (A/I ratio) in the polypeptide comprising the variant Fc region has a value of 10 or higher, 20 or higher, 30 or higher, 40 or higher, 50 or higher, 60 or higher, 70 or higher, 80 or higher, 90 or higher, 100 or higher, 200 or higher, 300 or higher, 400 or higher, 500 or higher, 600 or higher, 700 or higher, 800 or higher, 900 or higher, 1000 or higher, 2000 or higher, 3000 or higher, 4000 or higher, 5000 or higher, 6000 or higher, 7000 or higher, 8000 or higher, 9000 or higher, 10000 or higher, 11000 or higher, 12000 or higher, 13000 or higher, 14000 or higher, or 15000 or higher.

[121] The polypeptide of any one of to [120-5], wherein the activating Fcγ receptor is at least one Fcγ receptor selected from the group consisting of FcγRIa, FcγRIIa, and FcγRIIIa, and the inhibitory Fcγ receptor is FcγRIIb.

[122] The polypeptide of any one of [101] to [121], wherein the polypeptide comprising the variant Fc region is an antibody.

[123] A method for producing a polypeptide comprising a variant Fc region, which comprises introducing amino acid alterations into a parent Fc region, wherein the parent Fc region is composed of two polypeptide chains, and amino acid alterations are introduced into the following positions:

(i) positions 234, 235, 236, 239, 268, 270, and 298 according to EU numbering in the first polypeptide of the parent Fc region; and
(ii) positions 270, 298, 326, and 334 according to EU numbering in the second polypeptide of the parent Fc region.

[124] A method for producing a polypeptide comprising a variant Fc region, which comprises introducing amino acid alterations into a parent Fc region, wherein the parent Fc region is composed of two polypeptide chains, and wherein amino acid alterations are introduced into the following positions:

(i) positions 234, 235, 236, 239, 268, 270, 298, and 326 according to EU numbering in the first polypeptide of the parent Fc region; and
(ii) positions 236, 270, 298, 326, and 334 according to EU numbering in the second polypeptide of the parent Fc region.

[125] A method for producing a polypeptide comprising a variant Fc region, which comprises introducing amino acid alterations into a parent Fc region, wherein the parent Fc region is composed of two polypeptide chains, and wherein amino acid alterations are introduced into the following positions:

(i) positions 234, 235, 236, 239, 268, 270, 298, 330, and 332 according to EU numbering in the first polypeptide of the parent Fc region; and
(ii) positions 236, 270, 298, 326, 330, 332, and 334 according to EU numbering in the second polypeptide of the parent Fc region.

[126] An isolated nucleic acid encoding the polypeptide of any one of [101] to [122].

[127] A host cell comprising the nucleic acid of [126].

[128] A method for producing a polypeptide, which comprises culturing the host cell of such that the polypeptide is produced.

[129] The polypeptide of any one of [101] to [122], which is for use in treatment of a tumor.

[130] The polypeptide of any one of [101] to [122], which is for use in damaging a cell.

[131] The polypeptide of [130], wherein damaging a cell is by ADCC activity, CDC activity, or ADCP activity.

[132] A pharmaceutical composition comprising the polypeptide of any one of to and a pharmaceutically acceptable carrier.

[133] The pharmaceutical composition of [132], which is a pharmaceutical composition for treating a tumor.

[134] The pharmaceutical composition of [132], which is a pharmaceutical composition for damaging a cell.

[135] The pharmaceutical composition of [134], wherein damaging a cell is by ADCC activity, CDC activity, or ADCP activity.

[136] A method for treating a tumor, which comprises administering the polypeptide of any one of [101] to [122] or the pharmaceutical composition of [132].

[137] A method for damaging a cell, which comprises administering the polypeptide of any one of [101] to [122] or the pharmaceutical composition of [132].

[138] The method of [137], wherein damaging a cell is by ADCC activity, CDC activity, or ADCP activity.

[139] Use of the polypeptide of any one of [101] to [122] in manufacture of an agent for treating a tumor.

[140] Use of the polypeptide of any one of [101] to [122] in manufacture of an agent for damaging a cell.

[141] The use of [140], wherein damaging a cell is by ADCC activity, CDC activity, or ADCP activity.

[142] A method for modifying a function of a polypeptide comprising a Fc region, which comprises introducing amino acid alterations into a parent Fc region, wherein the parent Fc region is composed of two polypeptide chains, and amino acid alterations are introduced into the following positions:
  (i) positions 234, 235, 236, 239, 268, 270, and 298 according to EU numbering in the first polypeptide of the parent Fc region; and
  (ii) positions 270, 298, 326, and 334 according to EU numbering in the second polypeptide of the parent Fc region.

[143] A method for modifying a function of a polypeptide comprising a Fc region, which comprises introducing amino acid alterations into a parent Fc region, wherein the parent Fc region is composed of two polypeptide chains, and amino acid alterations are introduced into the following positions:
  (i) positions 234, 235, 236, 239, 268, 270, 298, and 326 according to EU numbering in the first polypeptide of the parent Fc region; and
  (ii) positions 236, 270, 298, 326, and 334 according to EU numbering in the second polypeptide of the parent Fc region.

[144] A method for modifying a function of a polypeptide comprising a Fc region, which comprises introducing amino acid alterations into a parent Fc region, wherein the parent Fc region is composed of two polypeptide chains, and amino acid alterations are introduced into the following positions:
  (i) positions 234, 235, 236, 239, 268, 270, 298, 330, and 332 according to EU numbering in the first polypeptide of the parent Fc region; and
  (ii) positions 236, 270, 298, 326, 330, 332, and 334 according to EU numbering in the second polypeptide of the parent Fc region.

[145] The method of any one of [142] to [144], wherein the modification of the function is enhancement of binding activity to FcγRIIa and FcγRIIIa.

[146] The method of any one of [142] to [144], wherein the modification of the function is improvement of selectivity between an activating Fcγ receptor and an inhibitory Fcγ receptor.

[147] The method of any one of [142] to [144], wherein the modification of the function is selective enhancement of binding activity to an activating Fcγ receptor as compared to binding activity to an inhibitory Fcγ receptor.

[148] The method of any one of [142] to [144], wherein the modification of the function is an increase in a ratio of binding activity to an activating Fcγ receptor to binding activity to an inhibitory Fcγ receptor (A/I ratio).

[149] The method of [148], wherein the ratio (A/I ratio) is increased 1.1 times or more, 1.2 times or more, 1.3 times or more, 1.4 times or more, 1.5 times or more, 1.6 times or more, 1.7 times or more, 1.8 times or more, 1.9 times or more, 2 times or more, 3 times or more, 4 times or more, 5 times or more, 6 times or more, 7 times or more, 8 times or more, 9 times or more, 10 times or more, 20 times or more, 30 times or more, 40 times or more, 50 times or more, 60 times or more, 70 times or more, 80 times or more, 90 times or more, 100 times or more, 200 times or more, 300 times or more, 400 times or more, 500 times or more, 600 times or more, 700 times or more, 800 times or more, 900 times or more, 1000 times or more, 2000 times or more, 3000 times or more, 4000 times or more, 5000 times or more, 6000 times or more, 7000 times or more, 8000 times or more, 9000 times or more, or 10000 times or more compared to that in a polypeptide comprising the parent Fc region.

[150] The method of any one of [142] to [149], wherein the activating Fcγ receptor is at least one Fcγ receptor selected from the group consisting of FcγRIa, FcγRIIa, and FcγRIIIa, and the inhibitory Fcγ receptor is FcγRIIb.

[151] The method of any one of [142] to [144], wherein the modification of the function is enhancement of ADCC activity, CDC activity, or ADCP activity.

BRIEF DESCRIPTION OF DRAWINGS

FIG. 24 shows mapping of the epitope of ABAM004 Fab fragment in the hCTLA4 amino acid sequence as described in Reference Example 2-14. In the figure, the amino acid residues indicated in black are those of hCTLA4 which comprise one or more non-hydrogen atoms located within a distance of 4.2 Å from any part of ABAM004 or AMP in the crystal structure. The amino acid residues indicated in gray shows residues whose model was not constructed because they were disordered in the crystal structure.

Figure 40:
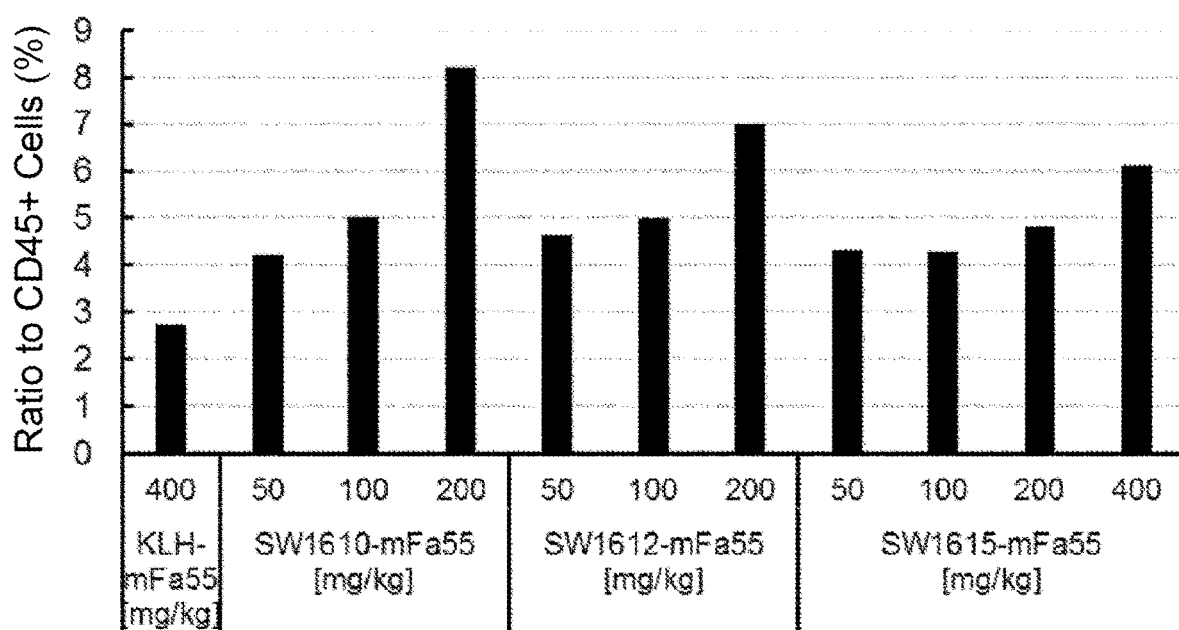

FIG. 40 shows the changes in the ratio of activated helper T cells in the spleen when the anti-CTLA-4 antibody SW1610-mFa55, SW1612-mFa55, or SW1615-mFa55 (all of which are switch antibodies) was administered in a mouse model transplanted with the Hepa1-6/hGPC3 cell line, as described in Reference Example 5-4-9. SW1610-mFa55 was administered at 50 mg/kg, 100 mg/kg, and 200 mg/kg, SW1612-mFa55 was administered at 50 mg/kg, 100 mg/kg, and 200 mg/kg, SW1615-mFa55 was administered at 50 mg/kg, 100 mg/kg, 200 mg/kg, and 400 mg/kg, and the negative control antibody KLH-mFa55 was administered at 400 mg/kg, via the tail vein. The spleen was harvested six days after the administration, and the increase or decrease in activated helper T cells was evaluated by FACS analysis. The longitudinal axis is the ratio of activated helper T cells (CD4+ Foxp3-ICOS+) to CD45+ cells. The mean value of n=3 is shown.

Figure 41:
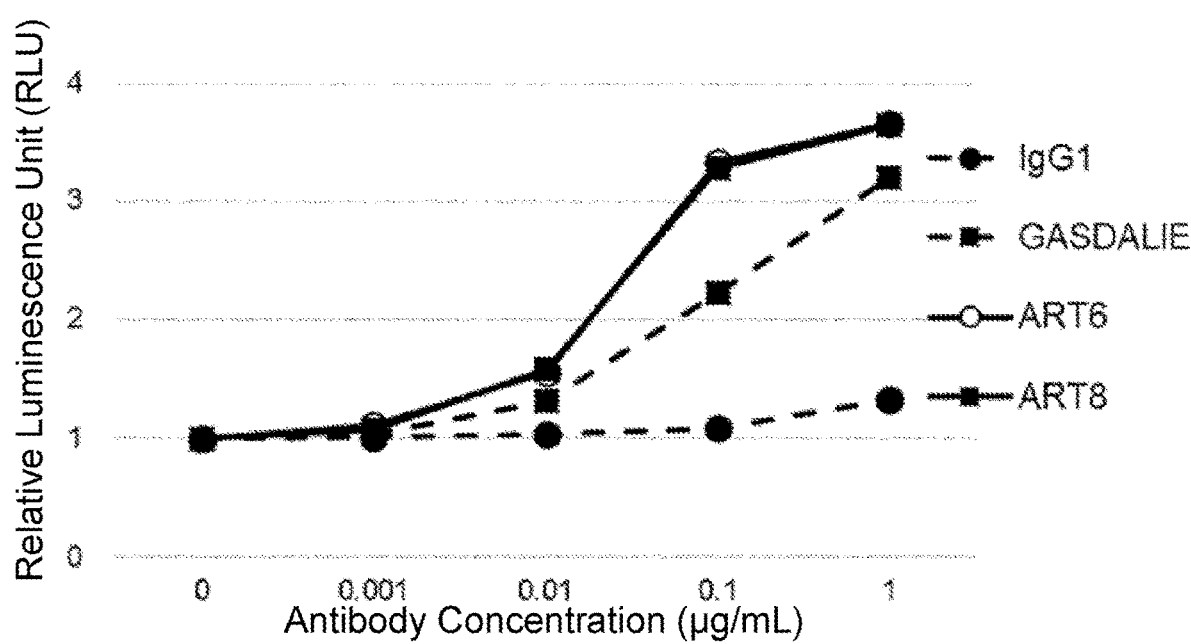

FIG. 41 shows a comparison of the in vitro ADCC activity of antibodies having various altered constant regions with enhanced binding to FcγR, as described in Reference Example 6-2. As notations in the figure, IgG1 represents MDX10D1H-G1m/MDX10D1L-k0MT, GASDALIE represents MDX10D1H-GASDALIE/MDX10D1L-k0MT, ART6 represents MDX10D1H-Kn462/MDX10D1H-H1445/MDX10D1L-k0MT, and ART8 represents MDX10D1H-Kn461/MDX10D1H-H1443/MDX10D1L-k0MT. Here, IgG1 is an antibody having a control constant region, GASDALIE is an antibody having a constant region described in a prior art reference, and ART6 and ART8 are antibodies having an altered constant region produced in Reference Example 6-1.

Figure 42:
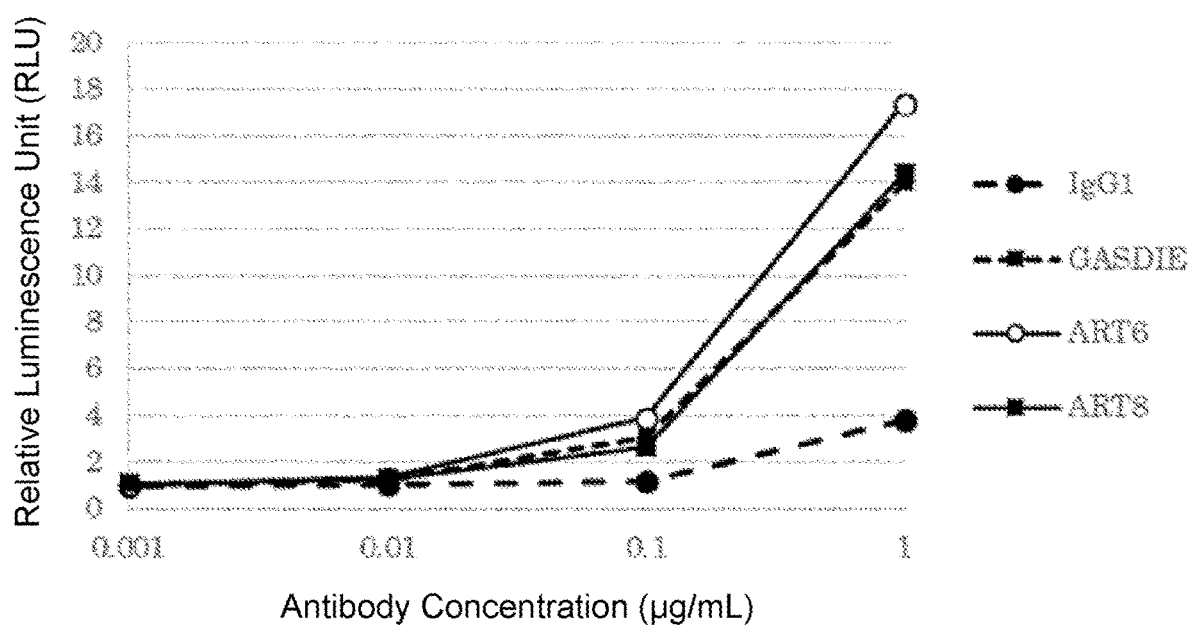

FIG. 42 shows a comparison of the in vitro ADCP activity of antibodies having various altered constant regions with enhanced binding to FcγR, as described in Reference Example 6-3. As notations in the figure, IgG1 represents MDX10D1H-G1m/MDX10D1L-k0MT, GASDIE represents MDX10D1H-GASDIE/MDX10D1L-k0MT, ART6 represents MDX10D1H-Kn462/MDX10D1H-H1445/MDX10D1L-k0MT, and ART8 represents MDX10D1H-Kn461/MDX10D1H-H1443/MDX10D1L-k0MT. Here, IgG1 is an antibody having a control constant region, GASDIE is an antibody having a constant region described in a prior art reference, and ART6 and ART8 are antibodies having an altered constant region produced in Reference Example 6-1.

Figure 43:
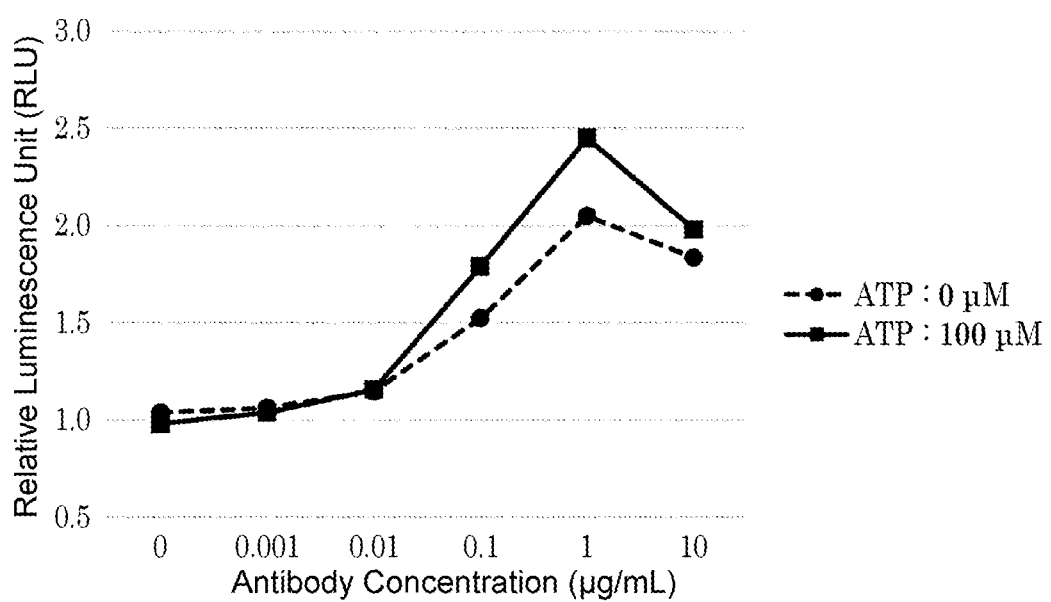

FIG. 43 shows the in vitro ADCC activity of the anti-CTLA4 switch antibody SW1389-ART6 having an altered constant region with enhanced binding to FcγR, as described in Reference Example 6-4.

Figure 44:
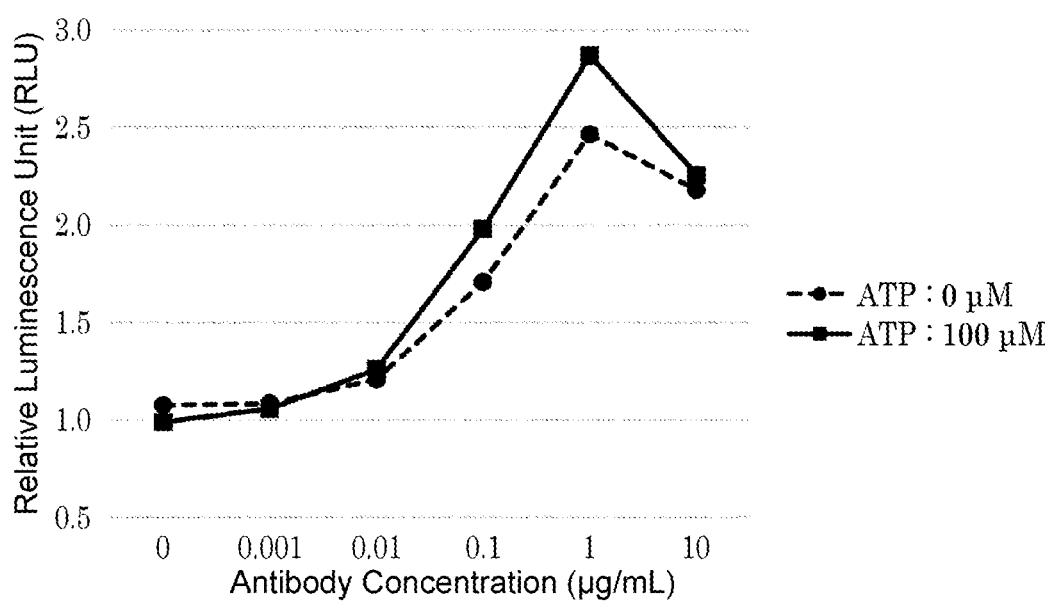

FIG. 44 shows the in vitro ADCC activity of the anti-CTLA4 switch antibody SW1610-ART6 having an altered constant region with enhanced binding to FcγR, as described in Reference Example 6-4.

Figure 45:
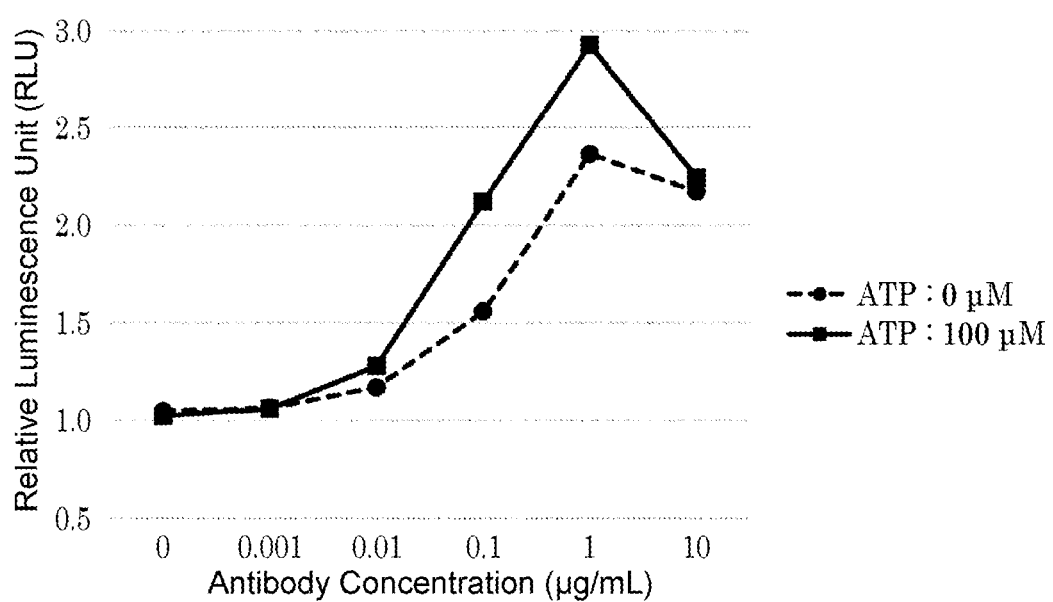

FIG. 45 shows the in vitro ADCC activity of the anti-CTLA4 switch antibody SW1612-ART6 having an altered constant region with enhanced binding to FcγR, as described in Reference Example 6-4.

Figure 46:
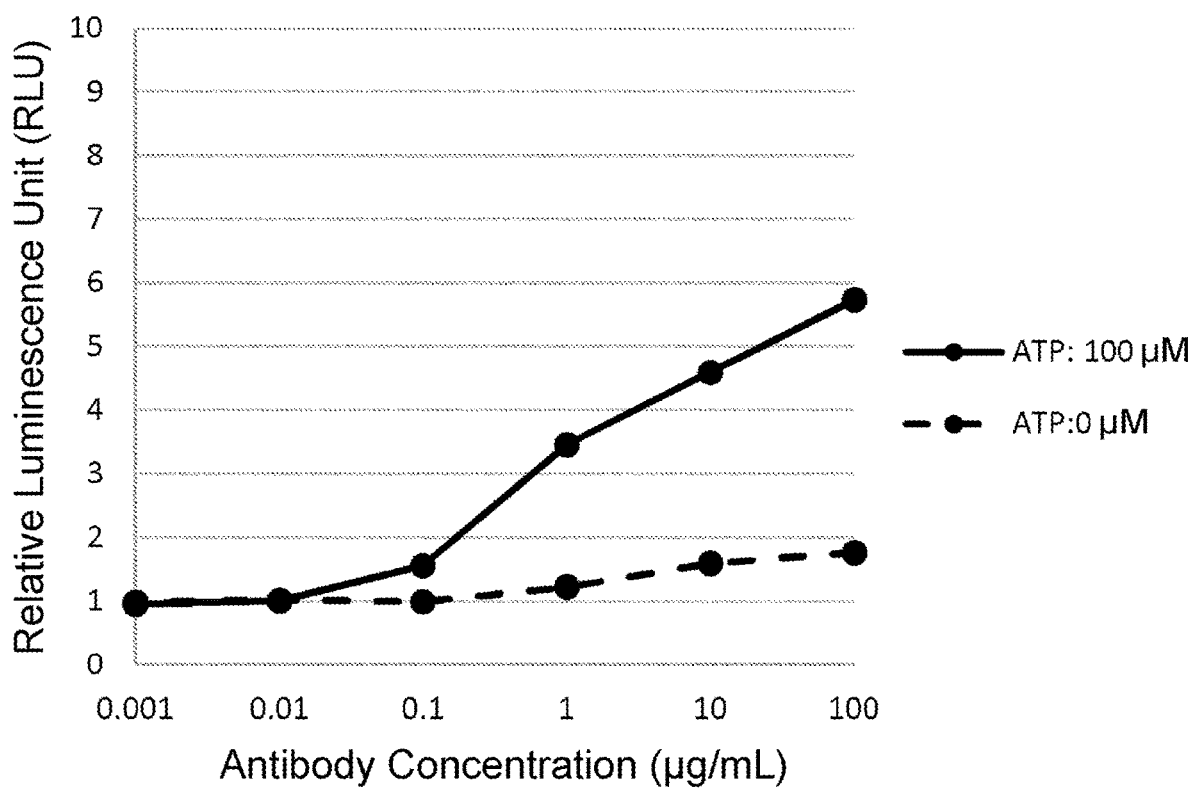

FIG. 46 shows the neutralizing activity of the anti-CTLA4 switch antibody SW1389 against CTLA4 (the activity to cancel the CTLA4 signal that acts in an inhibitory manner against the activation of effector cells), as described in Reference Example 6-5.

Figure 47:
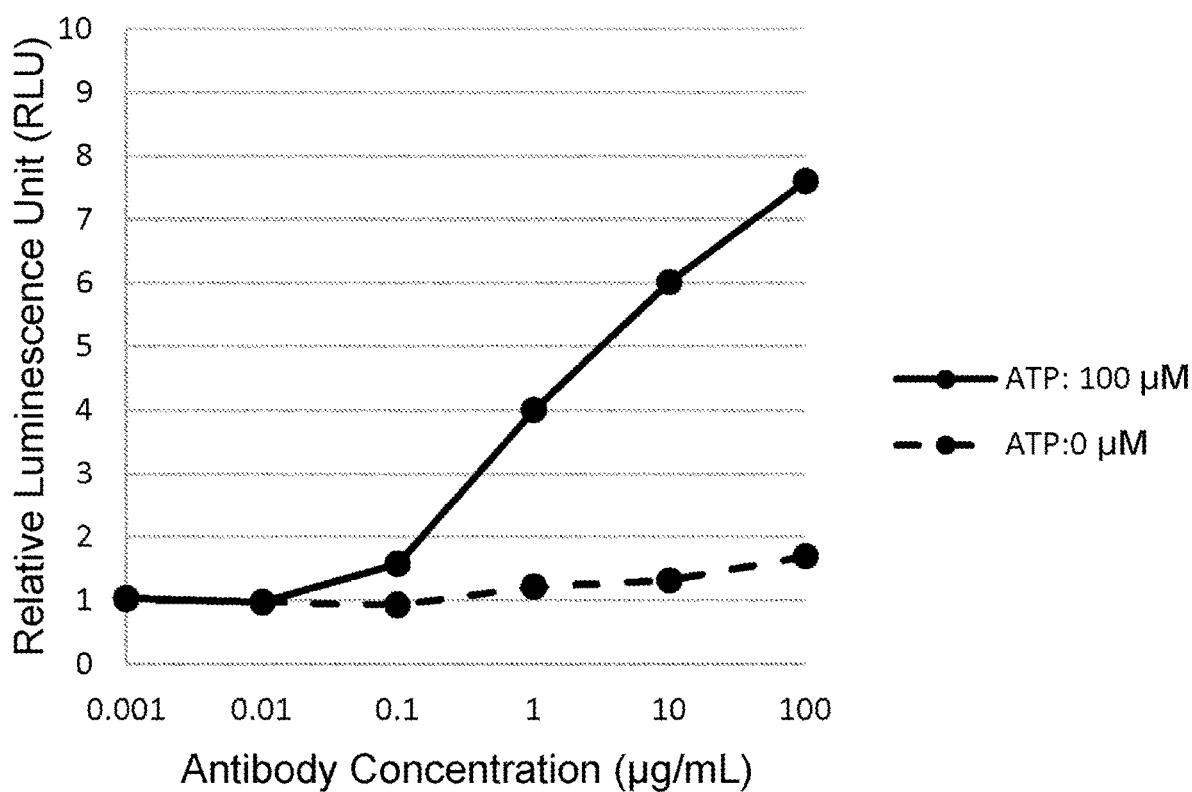

FIG. 47 shows the neutralizing activity of the anti-CTLA4 switch antibody SW1610 against CTLA4 (the activity to cancel the CTLA4 signal that acts in an inhibitory manner against the activation of effector cells), as described in Reference Example 6-5.

Figure 48:
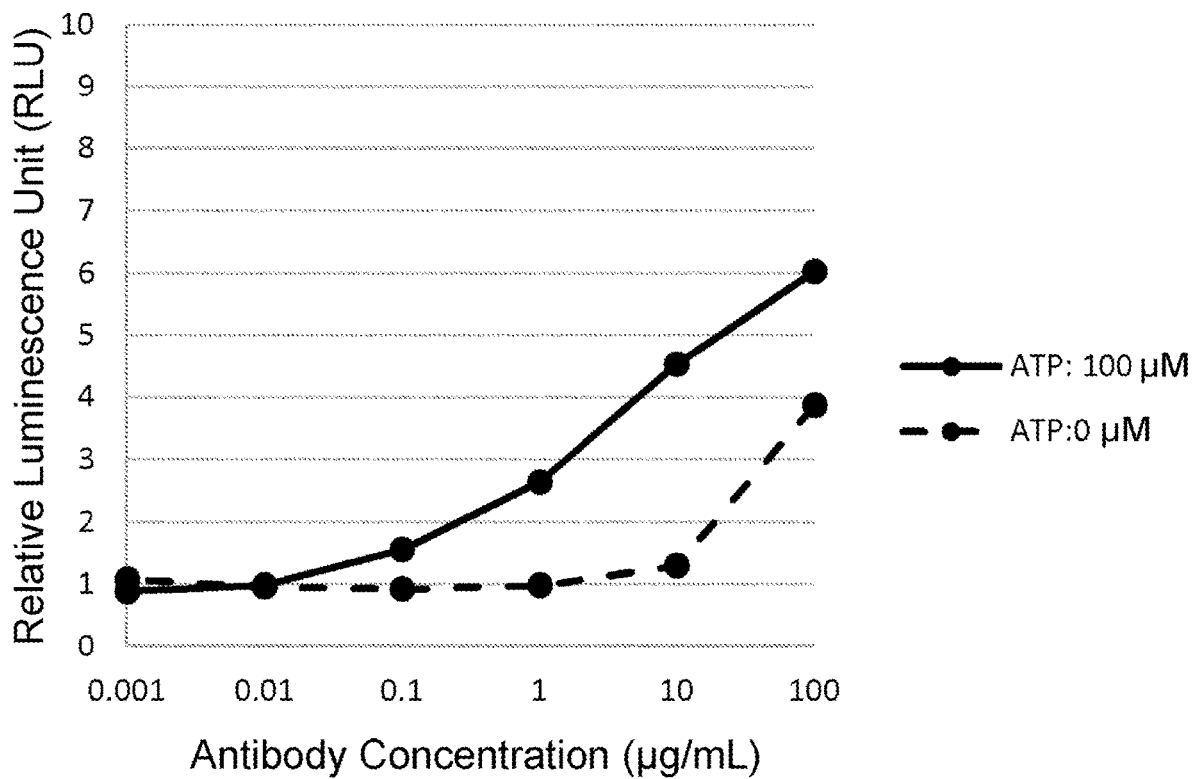

FIG. 48 shows the neutralizing activity of the anti-CTLA4 switch antibody SW1612 against CTLA4 (the activity to cancel the CTLA4 signal that acts in an inhibitory manner against the activation of effector cells), as described in Reference Example 6-5.

Figure 49:
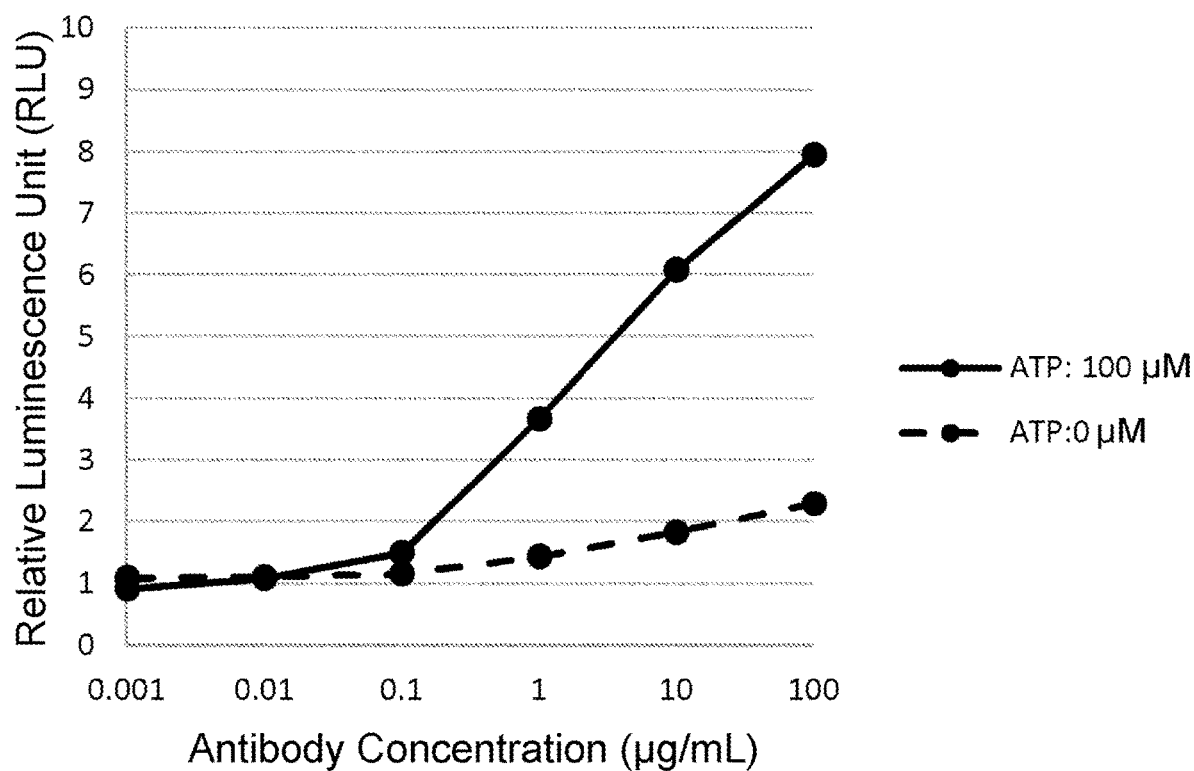

FIG. 49 shows the neutralizing activity of the anti-CTLA4 switch antibody SW1615 against CTLA4 (the activity to cancel the CTLA4 signal that acts in an inhibitory manner against the activation of effector cells), as described in Reference Example 6-5.

Figure 50:
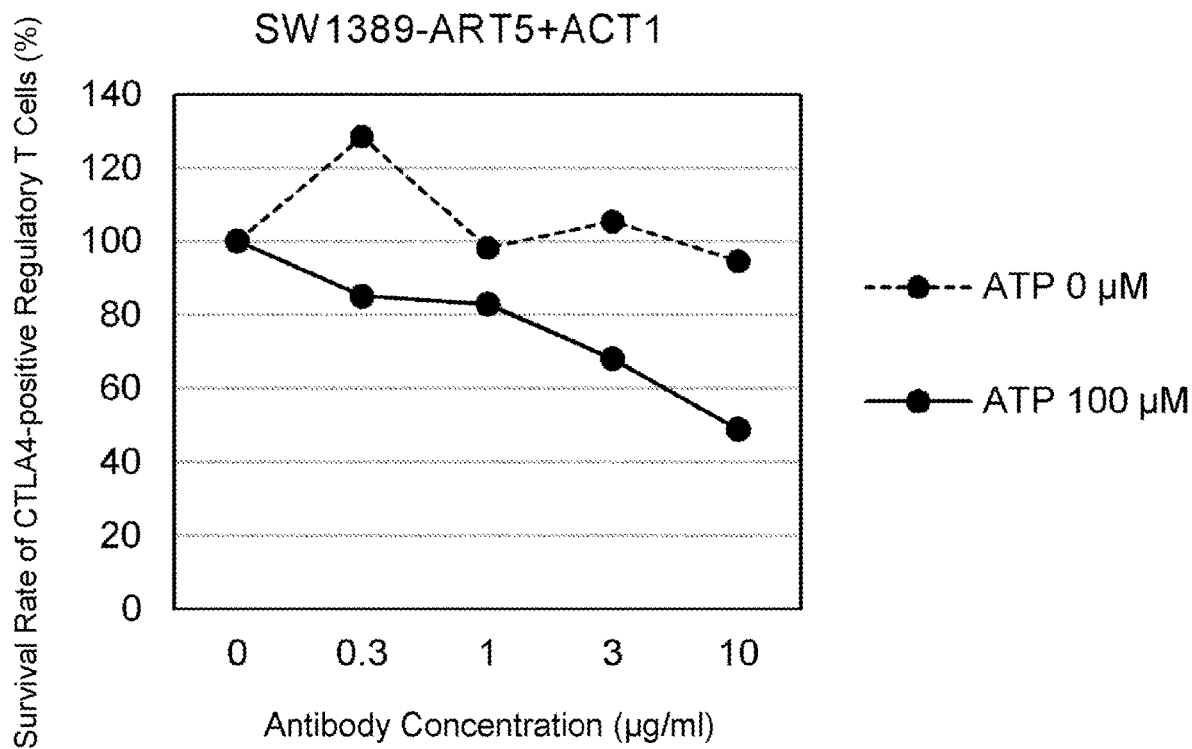

FIG. 50 shows the in vitro cytotoxic activity of the anti-CTLA4 switch antibody SW1389-ART5+ACT1 against CTLA4-positive regulatory T cells, as described in Reference Example 6-6.

Figure 51:
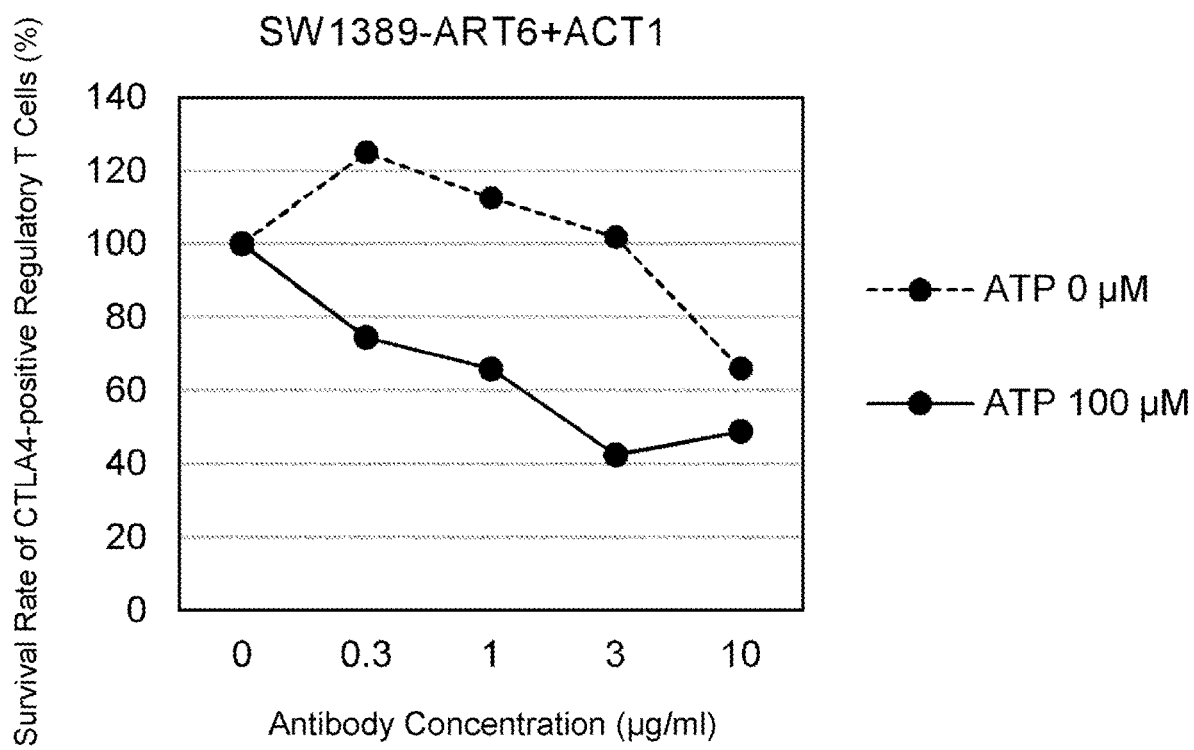

FIG. 51 shows the in vitro cytotoxic activity of the anti-CTLA4 switch antibody SW1389-ART6+ACT1 against CTLA4-positive regulatory T cells, as described in Reference Example 6-6.

Figure 52:
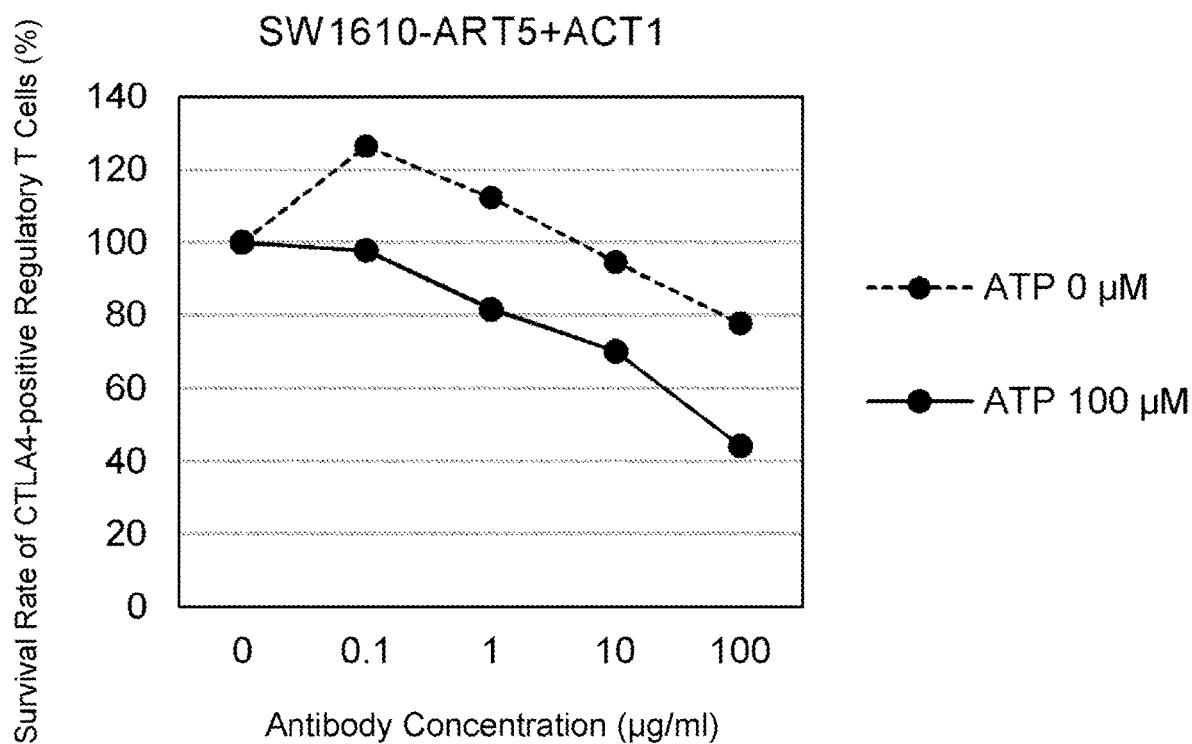

FIG. 52 shows the in vitro cytotoxic activity of the anti-CTLA4 switch antibody SW1610-ART5+ACT1 against CTLA4-positive regulatory T cells, as described in Reference Example 6-6.

Figure 53:
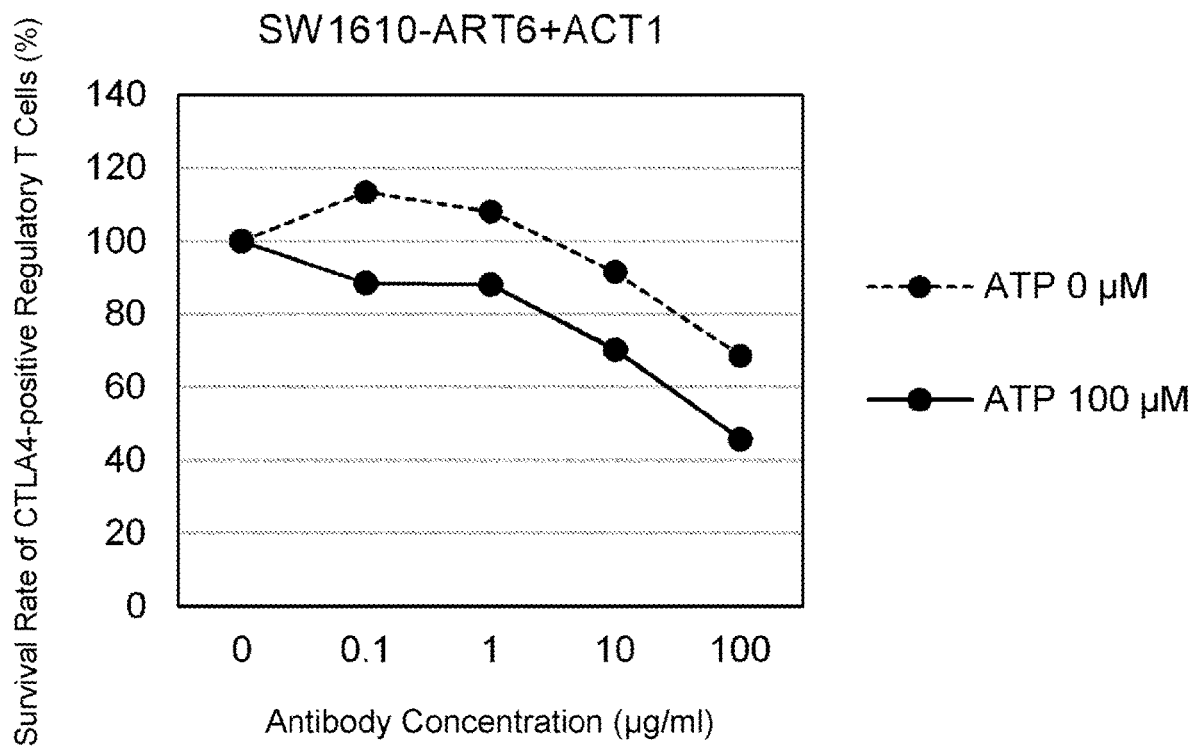

FIG. 53 shows the in vitro cytotoxic activity of the anti-CTLA4 switch antibody SW1610-ART6+ACT1 against CTLA4-positive regulatory T cells, as described in Reference Example 6-6.

Figure 54:
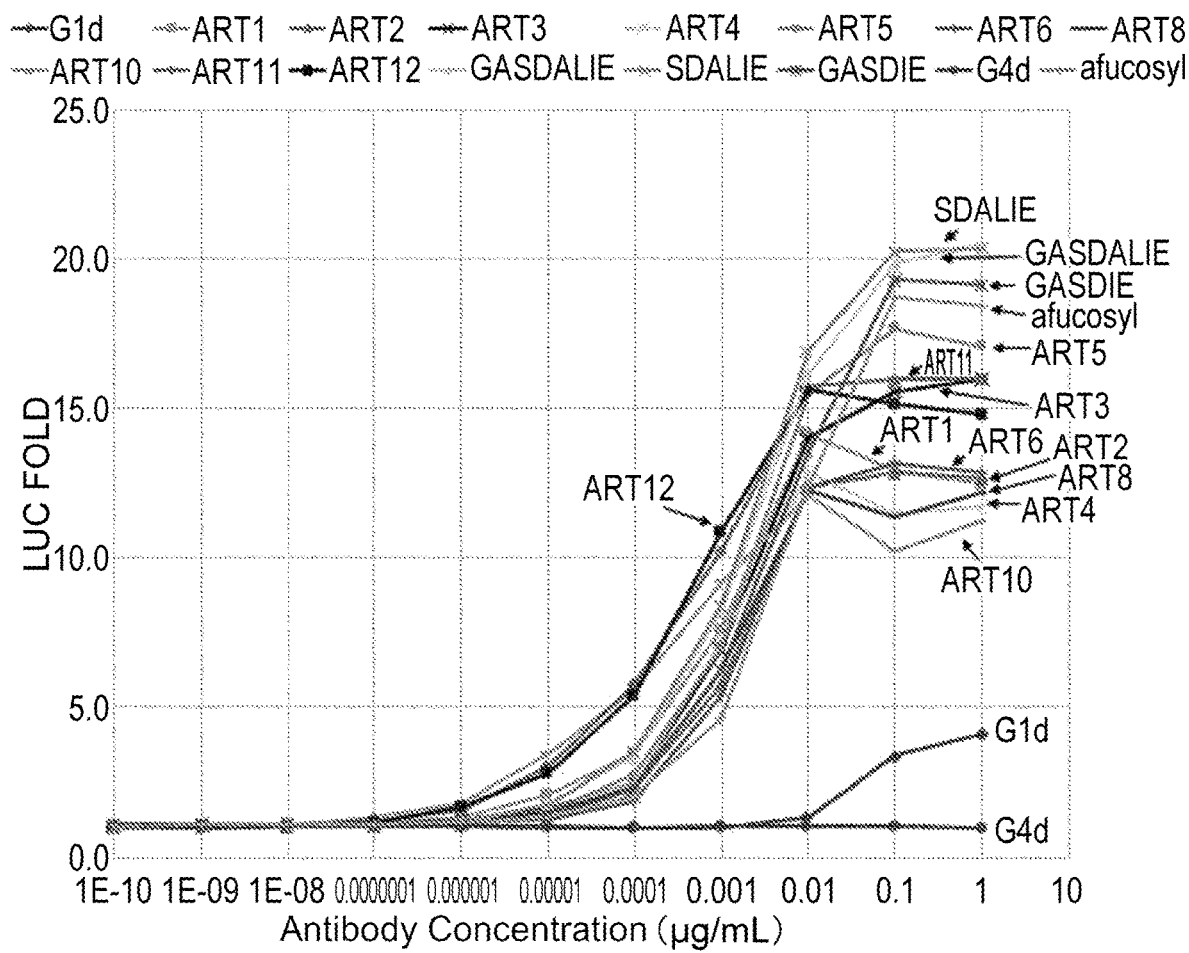

FIG. 54 shows the result of an ADCC reporter gene assay where Hepa1-6/hEREG cells were used as target cells and Jurkat cells expressing hFcγRIIIaV were used as effector cells, as described in Reference Example 9-2. Each point indicates the mean fold induction value, n=2.

Figure 55:
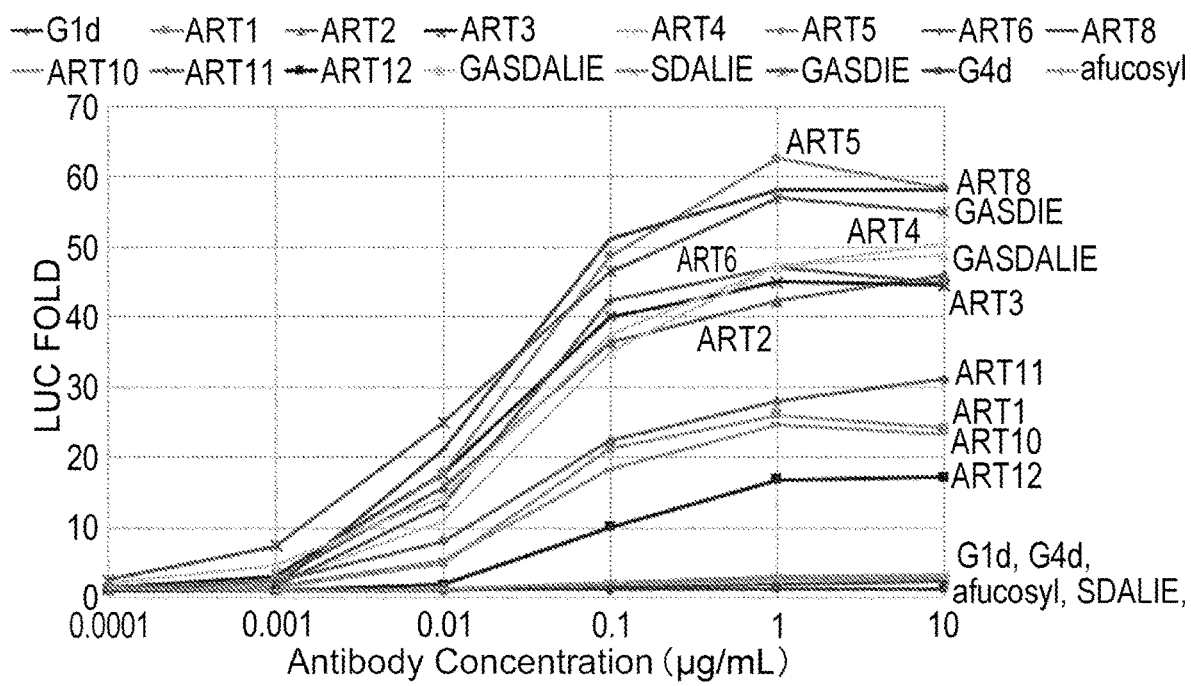

FIG. 55 shows the result of an ADCC reporter gene assay where Hepa1-6/hEREG cells were used as target cells and Jurkat cells expressing hFcγRIIaH were used as effector cells, as described in Reference Example 10. Each point indicates the mean fold induction value, n=3.

Figure 56:
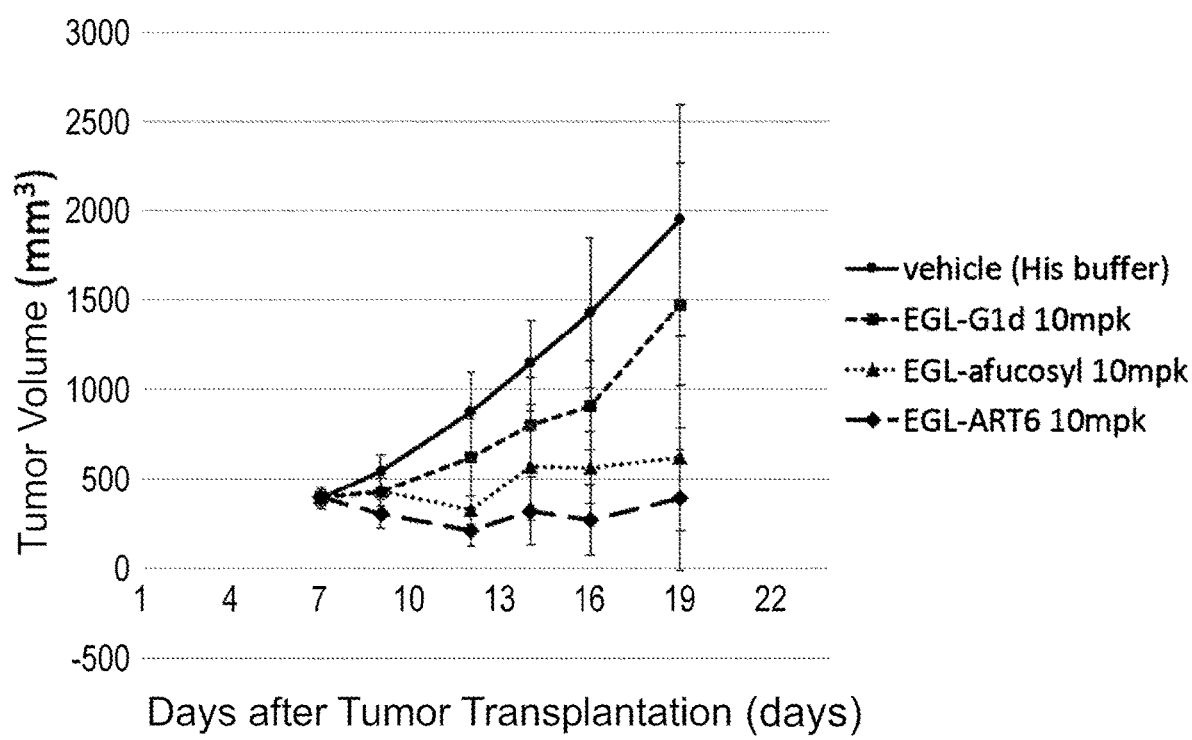

FIG. 56 shows the antitumor effect of EGL-G1d, EGL-afucosyl, and EGL-ART6 in a human FcγR transgenic mouse model into which the Hepa1-6/hEREG cell line was transplanted, as described in Reference Example 11-5. The antibody was administered at 10 mg/kg via the tail vein. Each point indicates the mean tumor volume for one group, n=5.

Figure 57:
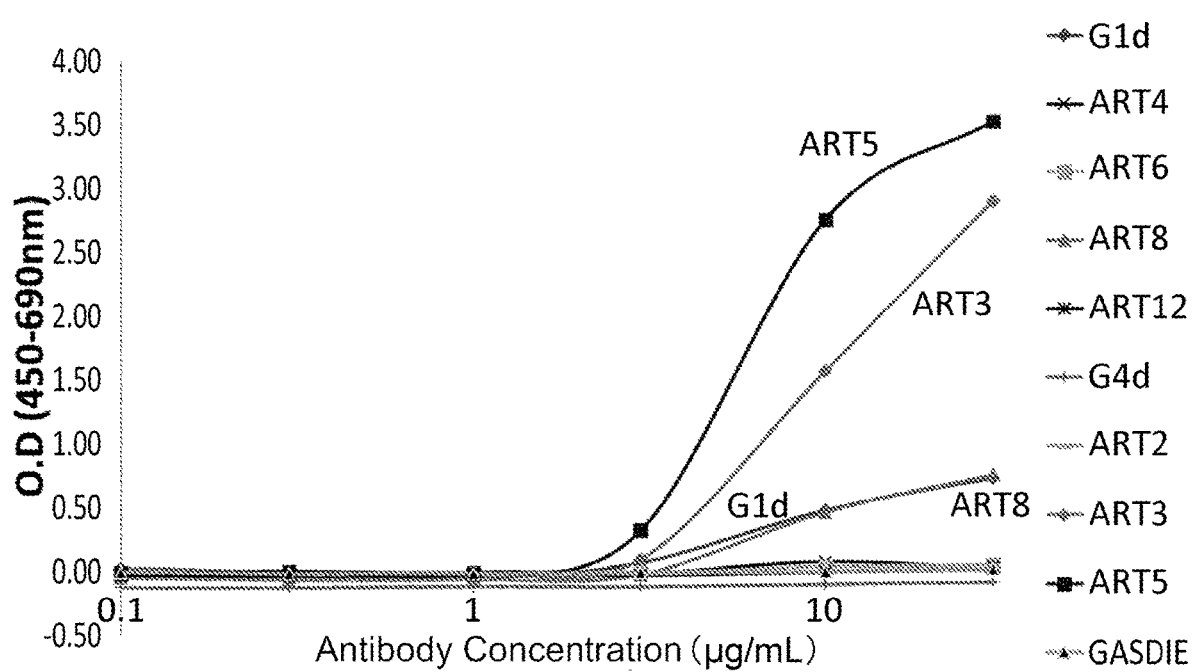

FIG. 57 shows the hC1q-binding activity of each antibody having a modified Fc, as described in Reference Example 12. Each point indicates the mean ELISA color development value, n=2.

Figure 58:
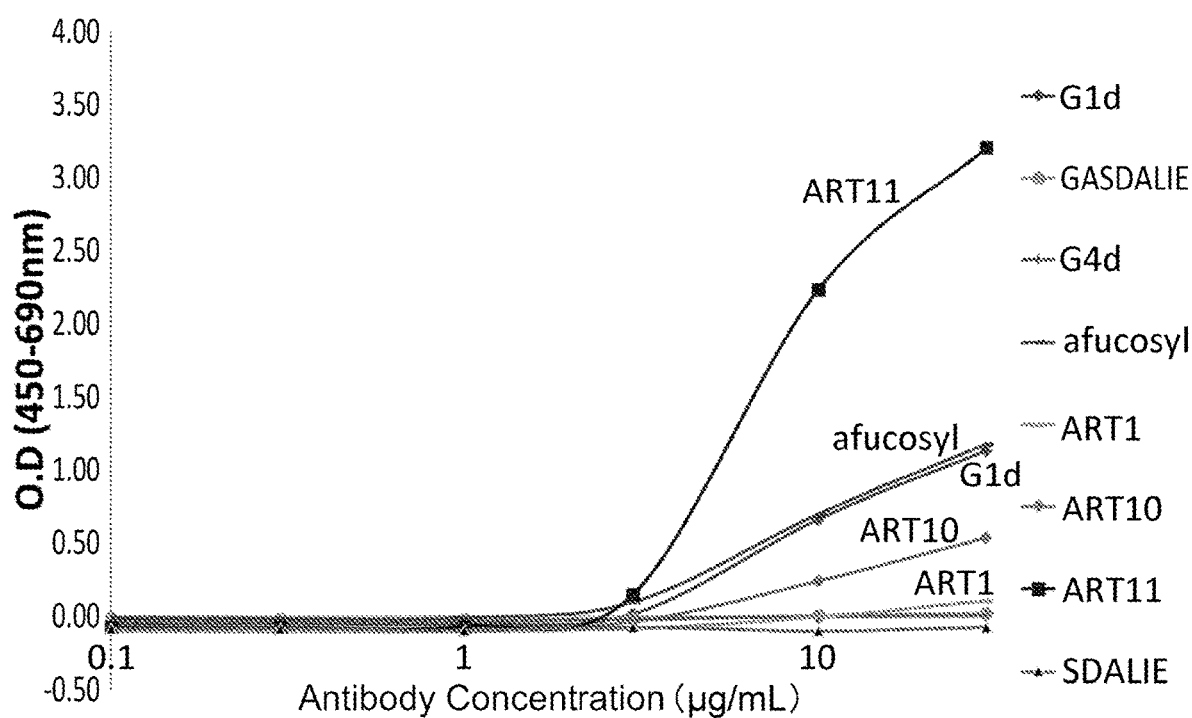

FIG. 58 also shows the hC1q-binding activity of each antibody having a modified Fc, as described in Reference Example 12. Each point indicates the mean ELISA color development value, n=2.

DESCRIPTION OF EMBODIMENTS

The techniques and procedures described or referenced herein are generally well understood and commonly employed using conventional methodology by those skilled in the art, such as, for example, the widely utilized methodologies described in Sambrook et al., Molecular Cloning:

A Laboratory Manual 3rd edition (2001) Cold Spring Harbor Laboratory Press, Cold Spring Harbor, N.Y.; Current Protocols in Molecular Biology (F. M. Ausubel, et al., eds., (2003)); the series Methods in Enzymology (Academic Press, Inc.): PCR 2: A Practical Approach (M. J. MacPherson, B. D. Hames and G. R. Taylor eds. (1995)), Harlow and Lane, eds. (1988) Antibodies, A Laboratory Manual, and Animal Cell Culture (R. I. Freshney, ed. (1987)); Oligonucleotide Synthesis (M. J. Gait, ed., 1984); Methods in Molecular Biology, Humana Press; Cell Biology: A Laboratory Notebook (J. E. Cellis, ed., 1998) Academic Press; Animal Cell Culture (R. I. Freshney), ed., 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds., 1993-8) J. Wiley and Sons; Handbook of Experimental Immunology (D. M. Weir and C. C. Blackwell, eds.); Gene Transfer Vectors for Mammalian Cells (J. M. Miller and M. P. Calos, eds., 1987); PCR: The Polymerase Chain Reaction, (Mullis et al., eds., 1994); Current Protocols in Immunology (J. E. Coligan et al., eds., 1991); Short Protocols in Molecular Biology (Wiley and Sons, 1999); Immunobiology (C. A. Janeway and P. Travers, 1997); Antibodies (P. Finch, 1997); Antibodies: A Practical Approach (D. Catty, ed., IRL Press, 1988-1989); Monoclonal Antibodies: A Practical Approach (P. Shepherd and C. Dean, eds., Oxford University Press, 2000); Using Antibodies: A Laboratory Manual (E. Harlow and D. Lane, Cold Spring Harbor Laboratory Press, 1999); The Antibodies (M. Zanetti and J. D. Capra, eds., Harwood Academic Publishers, 1995); and Cancer: Principles and Practice of Oncology (V. T. DeVita et al., eds., J.B. Lippincott Company, 1993).

I. Definitions

Unless defined otherwise, technical and scientific terms used herein have the same meaning as commonly understood by one skilled in the art to which the present invention belongs. Singleton et al., Dictionary of Microbiology and Molecular Biology 2nd ed., J. Wiley & Sons (New York, N.Y. 1994), and March, Advanced Organic Chemistry Reactions, Mechanisms and Structure 4th ed., John Wiley & Sons (New York, N.Y. 1992), provide one skilled in the art with a general guide to many of the terms used in the present application. All references cited herein, including patent applications and publications, are incorporated herein by reference in their entirety.

For purposes of interpreting the present specification, the following definitions apply and whenever appropriate, terms used in the singular also include the plural and vice versa. It is to be understood that the terminology used herein is for the purpose of describing particular embodiments only, and is not intended to be limiting. In the event that any definition set forth below conflicts with any document incorporated herein by reference, the definition set forth below shall control.

Herein, the term "and/or" refers to each of items written before and after the term "and/or" or any combination of those items. For example, the phrase "A, B, and/or C" includes the individual items "A", "B" and "C", and any combination selected from "A and B", "A and C", "B and C", and "A and B and C".

An "acceptor human framework" for the purposes herein is a framework comprising the amino acid sequence of a light chain variable domain (VL) framework or a heavy chain variable domain (VH) framework derived from a human immunoglobulin framework or a human consensus framework, as defined below. An acceptor human framework "derived from" a human immunoglobulin framework or a human consensus framework may comprise the same amino acid sequence thereof, or it may contain amino acid sequence changes. In some embodiments, the number of amino acid changes are 10 or less, 9 or less, 8 or less, 7 or less, 6 or less, 5 or less, 4 or less, 3 or less, or 2 or less. In some embodiments, the VL acceptor human framework is identical in sequence to the VL human immunoglobulin framework sequence or human consensus framework sequence.

"Antibody-dependent cell-mediated cytotoxicity" or "ADCC" refers to a form of cytotoxicity in which secreted immunoglobulin bound onto Fc receptors (FcRs) present on certain cytotoxic cells (e.g., NK cells, neutrophils, and macrophages) enable these cytotoxic effector cells to bind specifically to an antigen-bearing target cell and subsequently kill the target cell with cytotoxins. The primary cells for mediating ADCC, NK cells, express FcγRIII only, whereas monocytes express FcγRI, FcγRII, and FcγRIII. FcR expression on hematopoietic cells is summarized in Table 3 on page 464 of Ravetch and Kinet, Annu. Rev. Immunol 9: 457-92 (1991). To assess ADCC activity of a molecule of interest, an in vitro ADCC assay, such as that described in U.S. Pat. No. 5,500,362 or 5,821,337 or U.S. Pat. No. 6,737,056 (Presta), may be performed. Useful effector cells for such assays include PBMC and NK cells. Alternatively, or additionally, ADCC activity of the molecule of interest may be assessed in vivo, e.g., in an animal model such as that disclosed in Clynes et al. PNAS (USA) 95: 652-656 (1998).

"Cytotoxic activity" includes, for example, antibody-dependent cell-mediated cytotoxicity (ADCC) activity as mentioned above, complement-dependent cytotoxicity (CDC) activity as mentioned below, and T cell-mediated cytotoxic activity. CDC activity means the cytotoxic activity by the complement system. On the other hand, ADCC activity means the activity in which an antibody binds to an antigen present on the cell surface of a target cell and an effector cell further binds to the antibody, and thereby the effector cell damages the target cell. Whether an antibody of interest has ADCC activity and whether an antibody of interest has CDC activity can be measured by known methods (for example, Current Protocols in Immunology, Chapter 7, Immunologic studies in humans, edited by Coligan et al. (1993)).

"Neutralizing activity" refers to the activity of an antibody to inhibit some biological activity by binding to a molecule involved in the biological activity. In some embodiments, the biological activity is brought by the binding between a ligand and a receptor. In certain embodiments, an antibody inhibits the binding between a ligand and a receptor by binding to the ligand or to the receptor. Antibodies having such neutralizing activity are called neutralizing antibodies. The neutralizing activity of a certain test substance can be measured by comparing biological activity in the presence of a ligand between conditions in the presence and absence of the test substance.

The term "antibody-dependent cellular phagocytosis" or "ADCP" means the process in which either the whole or part of a cell covered by an antibody is incorporated into phagocytic immune cells (e.g., macrophages, neutrophils, and dendritic cells) that bind to an immunoglobulin Fc region.

The terms "binding activity" and "binding ability" are interchangeably used herein, and refer to the strength of the sum total of noncovalent interactions between one or more binding sites (e.g. a variable region or Fc region) of a molecule (e.g., an antibody or other polypeptide) and its binding partner (e.g., an antigen or Fcγ receptor). Herein, "binding activity" is not strictly limited to a 1:1 interaction between members of a binding pair (e.g., antibody and antigen, or Fc region and Fcγ receptor). For example, when members of a binding pair reflect a monovalent 1:1 interaction, the binding activity refers to the intrinsic binding affinity ("affinity"). When a member of a binding pair is capable of both monovalent and multivalent binding, the binding activity is the sum of each binding strength. The binding activity of a molecule X to its partner Y can generally be represented by the dissociation constant (KD) or "binding amount of analyte per unit amount of ligand". Binding activity can be measured by common methods known in the art, including those described herein. Specific illustrative and exemplary embodiments for measuring binding activity are described in the following.

An "affinity matured" antibody refers to an antibody with one or more alterations in one or more hypervariable regions (HVRs), compared to a parent antibody which does not possess such alterations, such alterations resulting in an improvement in the affinity of the antibody for antigen.

The terms "anti-CTLA-4 antibody" and "an antibody that binds to CTLA-4" refer to an antibody that is capable of binding CTLA-4 with sufficient affinity such that the antibody is useful as a diagnostic and/or therapeutic agent in targeting CTLA-4. In one embodiment, the extent of binding of an anti-CTLA-4 antibody to an unrelated, non-CTLA-4 protein is less than about 10% of the binding of the antibody to CTLA-4 as measured, e.g., by a radioimmunoassay (RIA). In certain embodiments, an antibody that binds to CTLA-4 has a dissociation constant (KD) of 1 µM or less, 100 nM or less, 10 nM or less, 1 nM or less, 0.1 nM or less, 0.01 nM or less, or 0.001 nM or less (e.g., $10^{-8}$ M or less, e.g., from $10^{-8}$ M to $10^{-13}$ M, e.g., from $10^{-9}$ M to $10^{-13}$ M). In certain embodiments, an anti-CTLA-4 antibody binds to an epitope of CTLA-4 that is conserved among CTLA-4 from different species.

The term "antibody" herein is used in the broadest sense and encompasses various antibody structures, including but not limited to monoclonal antibodies, polyclonal antibodies, multispecific antibodies (e.g., bispecific antibodies), and antibody fragments so long as they exhibit the desired antigen-binding activity.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, $F(ab')_2$; diabodies; linear antibodies; single-chain antibody molecules (e.g., scFv); and multispecific antibodies formed from antibody fragments.

An "antibody that binds to the same epitope" as a reference antibody refers to an antibody that blocks binding of the reference antibody to its antigen in a competition assay by, for example, 50% or more, and/or, the reference antibody blocks binding of the antibody to its antigen in a competition assay by, for example, 50% or more. An exemplary competition assay is provided herein.

"Autoimmune disease" refers to a non-malignant disease or disorder arising from and directed against an individual's own tissues. The autoimmune diseases herein specifically exclude malignant or cancerous diseases or conditions, especially excluding B cell lymphoma, acute lymphoblastic leukemia (ALL), chronic lymphocytic leukemia (CLL), Hairy cell leukemia and chronic myeloblastic leukemia. Examples of autoimmune diseases or disorders include, but are not limited to, inflammatory responses such as inflammatory skin diseases including psoriasis and dermatitis (e.g., atopic dermatitis); systemic scleroderma and sclerosis; responses associated with inflammatory bowel disease (such as Crohn's disease and ulcerative colitis); respiratory distress syndrome (including adult respiratory distress syndrome; ARDS); dermatitis; meningitis; encephalitis; uveitis; colitis; glomerulonephritis; allergic conditions such as eczema and asthma and other conditions involving infiltration of T cells and chronic inflammatory responses; atherosclerosis; leukocyte adhesion deficiency; rheumatoid arthritis; systemic lupus erythematosus (SLE) (including but not limited to lupus nephritis, cutaneous lupus); diabetes mellitus (e.g., Type I diabetes mellitus or insulin dependent diabetes mellitus); multiple sclerosis; Reynaud's syndrome; autoimmune thyroiditis; Hashimoto's thyroiditis; allergic encephalomyelitis; Sjogren's syndrome; juvenile onset diabetes; and immune responses associated with acute and delayed hypersensitivity mediated by cytokines and T-lymphocytes typically found in tuberculosis, sarcoidosis, polymyositis, granulomatosis and vasculitis; pernicious anemia (Addison's disease); diseases involving leukocyte diapedesis; central nervous system (CNS) inflammatory disorder; multiple organ injury syndrome; hemolytic anemia (including, but not limited to cryoglobulinemia or Coombs positive anemia); myasthenia gravis; antigen-antibody complex mediated diseases; anti-glomerular basement membrane disease; antiphospholipid syndrome; allergic neuritis; Graves' disease; Lambert-Eaton myasthenic syndrome; pemphigoid bullous; pemphigus; autoimmune polyendocrinopathies; Reiter's disease; stiff-man syndrome; Behcet disease; giant cell arteritis; immune complex nephritis; IgA nephropathy; IgM polyneuropathies; immune thrombocytopeniarpura (ITP) or autoimmune thrombocytopenia.

The terms "cancer" and "cancerous" refer to or describe the physiological condition in mammals that is typically characterized by unregulated cell growth/proliferation. Examples of cancer include breast cancer and liver cancer.

The term "complement-dependent cytotoxicity" or "CDC" means a mechanism for inducing cell death in which the Fc effector domain of an antibody bound to a target activates a series of enzymatic reactions, resulting in the formation of holes in the membrane of the target cell. Typically, the antigen-antibody complex formed on the target cell binds to and activates the complement component C1q, which in turn activates the complement cascade and leads to the target cell death. Moreover, complement activation may also result in the deposition of complement components on the surface of the target cell, which leads to binding to complement receptors (e.g., CR3) on leukocytes and thereby promotes ADCC.

A "chemotherapeutic agent" refers to a chemical compound useful in the treatment of cancer. Examples of chemotherapeutic agents include alkylating agents such as thiotepa and cyclophosphamide (CYTOXAN (registered trademark)); alkyl sulfonates such as busulfan, improsulfan and piposulfan; aziridines such as benzodopa, carboquone, meturedopa, and uredopa; ethylenimines and methylol melamines including altretamine, triethylenemelamine, triethylenephosphoramide, triethylenethiophosphoramide and trimethylomelamine; acetogenins (especially bullatacin and bullatacinone); delta-9-tetrahydrocannabinol (dronabinol, MARINOL (registered trademark)); beta-lapachone; lapachol; colchicines; betulinic acid; camptothecin (including the synthetic analogue topotecan (HYCAMTIN (registered trademark)), CPT-11 (irinotecan, CAMPTOSAR (registered trademark)), acetylcamptothecin, scopolectin, and 9-aminocamptothecin); bryostatin; callystatin; CC-1065 (including its adozelesin, carzelesin and bizelesin synthetic analogues); podophyllotoxin; podophyllinic acid; teniposide;

cryptophycins (particularly cryptophycin 1 and cryptophycin 8); dolastatin; duocarmycin (including the synthetic analogues, KW-2189 and CB1-TM1); eleutherobin; pancratistatin; sarcodictyin; spongistatin; nitrogen mustards such as chlorambucil, chlornaphazine, chlorophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, fotemustine, lomustine, nimustine, and ranimustine; antibiotics such as the enediyne antibiotics (e.g., calicheamicin, especially calicheamicin gamma1I and calicheamicin omegaI1 (see, e.g., Nicolaou et al., *Angew. Chem Intl. Ed. Engl.,* 33: 183-186 (1994)); CDP323, an oral alpha-4 integrin inhibitor; dynemicin, including dynemicin A; esperamicin; as well as neocarzinostatin chromophore and related chromoprotein enediyne antibiotic chromophores), aclacinomysins, actinomycin, anthramycin, azaserine, bleomycins, cactinomycin, carubicin, carminomycin, carzinophilin, chromomycins, dactinomycin, daunorubicin, detorubicin, 6-diazo-5-oxo-L-norleucine, doxorubicin (including ADRIAMYCIN (registered trademark)), morpholino-doxorubicin, cyanomorpholino-doxorubicin, 2-pyrrolino-doxorubicin, doxorubicin HCl liposome injection (DOXIL (registered trademark)), liposomal doxorubicin TLC D-99 (MYOCET (registered trademark)), peglylated liposomal doxorubicin (CAELYX (registered trademark)), and deoxydoxorubicin), epirubicin, esorubicin, idarubicin, marcellomycin, mitomycins such as mitomycin C, mycophenolic acid, nogalamycin, olivomycins, peplomycin, porfiromycin, puromycin, quelamycin, rodorubicin, streptonigrin, streptozocin, tubercidin, ubenimex, zinostatin, zorubicin; anti-metabolites such as methotrexate, gemcitabine (GEMZAR (registered trademark)), tegafur (UFTORAL (registered trademark)), capecitabine (XELODA (registered trademark)), an epothilone, and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as folinic acid; aceglatone; aldophosphamide glycoside; aminolevulinic acid; eniluracil; amsacrine; bestrabucil; bisantrene; edatrexate; defofamine; demecolcine; diaziquone; elfornithine; elliptinium acetate; an epothilone; etoglucid; gallium nitrate; hydroxyurea; lentinan; lonidamine; maytansinoids such as maytansine and ansamitocins; mitoguazone; mitoxantrone; mopidamol; nitraerine; pentostatin; phenamet; pirarubicin; losoxantrone; 2-ethylhydrazide; procarbazine; PSK (registered trademark) polysaccharide complex (JHS Natural Products, Eugene, OR); razoxane; rhizoxin; sizofiran; spirogermanium; tenuazonic acid; triaziquone; 2,2',2'-trichlorotriethylamine; trichothecenes (especially T-2 toxin, verracurin A, roridin A and anguidine); urethan; vindesine (ELDISINE (registered trademark), FILDESIN (registered trademark)); dacarbazine; mannomustine; mitobronitol; mitolactol; pipobroman; gacytosine; arabinoside ("Ara-C"); thiotepa; taxoid, e.g., paclitaxel (TAXOL (registered trademark)), albumin-engineered nanoparticle formulation of paclitaxel (ABRAXANE™), and docetaxel (TAXOTERE (registered trademark)); chlorambucil; 6-thioguanine; mercaptopurine; methotrexate; platinum agents such as cisplatin, oxaliplatin (e.g., ELOXATIN (registered trademark)), and carboplatin; vincas, which prevent tubulin polymerization from forming microtubules, including vinblastine (VELBAN (registered trademark)), vincristine (ONCOVIN (registered trademark)), vindesine (ELDISINE (registered trademark), FILDESIN (registered trademark)), and vinorelbine (NAVELBINE (registered trademark)); etoposide (VP-16); ifosfamide; mitoxantrone; leucovorin; novantrone; edatrexate; daunomycin; aminopterin; ibandronate; topoisomerase inhibitor RFS 2000; difluoromethylornithine (DMFO); retinoids such as retinoic acid, including bexarotene (TARGRETIN (registered trademark)); bisphosphonates such as clodronate (for example, BONEFOS (registered trademark) or OSTAC (registered trademark)), etidronate (DIDROCAL (registered trademark)), NE-58095, zoledronic acid/zoledronate (ZOMETA (registered trademark)), alendronate (FOSAMAX (registered trademark)), pamidronate (AREDIA (registered trademark)), tiludronate (SKELID (registered trademark)), or risedronate (ACTONEL (registered trademark)); troxacitabine (a 1,3-dioxolane nucleoside cytosine analog); antisense oligonucleotides, particularly those that inhibit expression of genes in signaling pathways implicated in aberrant cell proliferation, such as, for example, PKC-alpha, Raf, H-Ras, and epidermal growth factor receptor (EGF-R); vaccines such as THERATOPE (registered trademark) vaccine and gene therapy vaccines, for example, ALLOVECTIN (registered trademark) vaccine, LEUVECTIN (registered trademark) vaccine, and VAXID (registered trademark) vaccine; topoisomerase 1 inhibitor (e.g., LURTOTECAN (registered trademark)); rmRH (e.g., ABARELIX (registered trademark)); BAY439006 (sorafenib; Bayer); SU-11248 (sunitinib, SUTENT (registered trademark), Pfizer); perifosine, COX-2 inhibitor (e.g., celecoxib or etoricoxib), proteosome inhibitor (e.g., PS341); bortezomib (VELCADE (registered trademark)); CCI-779; tipifarnib (R11577); sorafenib, ABT510; Bcl-2 inhibitor such as oblimersen sodium (GENASENSE (registered trademark)); pixantrone; EGFR inhibitors (see definition below); tyrosine kinase inhibitors (see definition below); serine-threonine kinase inhibitors such as rapamycin (sirolimus, RAPAMUNE (registered trademark)); farnesyltransferase inhibitors such as lonafarnib (SCH 6636, SARASAR™); and pharmaceutically acceptable salts, acids or derivatives of any of the above; as well as combinations of two or more of the above such as CHOP, an abbreviation for a combined therapy of cyclophosphamide, doxorubicin, vincristine, and prednisolone; and FOLFOX, an abbreviation for a treatment regimen with oxaliplatin (ELOXATIN™) combined with 5-FU and leucovorin.

The term "chimeric" antibody refers to an antibody in which a portion of the heavy and/or light chain is derived from a particular source or species, while the remainder of the heavy and/or light chain is derived from a different source or species.

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g., IgG1, IgG2, IgG3, IgG4, IgA1, and IgA2. The heavy chain constant domains that correspond to the different classes of immunoglobulins are called $\alpha$, $\delta$, $\epsilon$, $\gamma$, and $\mu$, respectively.

The term "cytotoxic agent" as used herein refers to a substance that inhibits or prevents a cellular function and/or causes cell death or destruction. Cytotoxic agents include, but are not limited to, radioactive isotopes (e.g., $^{211}At$, $^{131}I$, $^{125}I$, $^{90}Y$, $^{186}Re$, $^{188}Re$, $^{153}Sm$, $^{212}Bi$, $^{32}P$, $^{212}Pb$ and radioactive isotopes of Lu); chemotherapeutic agents or drugs (e.g., methotrexate, adriamycin, *vinca* alkaloids (vincristine, vinblastine, etoposide), doxorubicin, melphalan, mitomycin C, chlorambucil, daunorubicin or other intercalating agents); growth inhibitory agents; enzymes and fragments thereof such as nucleolytic enzymes; antibiotics; toxins such as small molecule toxins or enzymatically active toxins of bacterial, fungal, plant or animal origin, including fragments and/or variants thereof; and the various chemotherapeutic agents disclosed above.

"Effector cells" refer to leukocytes that express one or more FcRs and perform effector functions. In certain embodiments, the cells express at least FcγRIII and perform ADCC effector function(s). Examples of leukocytes which mediate ADCC include peripheral blood mononuclear cells (PBMC), natural killer (NK) cells, monocytes, cytotoxic T cells, and neutrophils. The effector cells may be isolated from a native source, e.g., from blood. In certain embodiments, the effector cells may be human effector cells.

"Effector functions" refer to those biological activities attributable to the Fc region of an antibody, which vary with the antibody isotype. Examples of antibody effector functions include: C1q binding and complement-dependent cytotoxicity (CDC); Fc receptor binding; antibody-dependent cell-mediated cytotoxicity (ADCC); antibody-dependent cell-mediated phagocytosis (ADCP); down regulation of cell surface receptors (e.g., B cell receptor); and B cell activation.

The term "epitope" includes any determinant capable of being bound by an antibody. An epitope is a region of an antigen that is bound by an antibody that targets the antigen, and includes specific amino acids that directly contact the antibody. Epitope determinants can include chemically active surface groupings of molecules such as amino acids, sugar side chains, phosphoryl or sulfonyl groups, and can have specific three dimensional structural characteristics, and/or specific charge characteristics. Generally, antibodies specific for a particular target antigen preferentially recognize an epitope on the target antigen in a complex mixture of proteins and/or macromolecules.

The term "Fc receptor" or "FcR" refers to a receptor that binds to the Fc region of an antibody. In some embodiments, an FcR is a native human FcR. In some embodiments, an FcR is one which binds an IgG antibody (a gamma receptor) and includes receptors of the FcγRI, FcγRII, and FcγRIII subclasses, including allelic variants and alternatively spliced forms of those receptors. FcγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain. (see, e.g., Daeron, *Annu. Rev. Immunol.* 15: 203-234 (1997)). FcRs are reviewed, for example, in Ravetch and Kinet, *Annu. Rev. Immunol* 9: 457-492 (1991); Capel et al., *Immunomethods* 4: 25-34 (1994); and de Haas et al., *J. Lab. Clin. Med.* 126: 330-341 (1995). Other FcRs, including those to be identified in the future, are encompassed by the term "FcR" herein.

The term "Fc receptor" or "FcR" also includes the neonatal receptor, FcRn, which is responsible for the transfer of maternal IgGs to the fetus (Guyer et al., *J. Immunol.* 117: 587 (1976); and Kim et al., *J. Immunol.* 24: 249 (1994)) and regulation of homeostasis of immunoglobulins. Methods of measuring binding to FcRn are known (see, e.g., Ghetie and Ward., *Immunol. Today* 18 (12): 592-598 (1997); Ghetie et al., *Nature Biotechnology,* 15 (7): 637-640 (1997); Hinton et al., *J. Biol. Chem.* 279 (8): 6213-6216 (2004); WO 2004/92219 (Hinton et al.)).

Binding to human FcRn in vivo and serum half life of human FcRn high affinity binding polypeptides can be assayed, e.g., in transgenic mice or transfected human cell lines expressing human FcRn, or in primates to which the polypeptides with a variant Fc region are administered. WO 2000/42072 (Presta) describes antibody variants with improved or decreased binding to FcRs. See also, e.g., Shields et al., *J. Biol. Chem.* 9 (2): 6591-6604 (2001).

The term "Fc region" herein is used to define a C-terminal region of an immunoglobulin heavy chain that contains at least a portion of the constant region. The term includes native sequence Fc regions and variant Fc regions. In one embodiment, a human IgG heavy chain Fc region extends from Cys226, or from Pro230, to the carboxyl-terminus of the heavy chain. However, the C-terminal lysine (Lys447) or glycine-lysine (Gly446-Lys447) of the Fc region may or may not be present. Unless otherwise specified herein, numbering of amino acid residues in the Fc region or constant region is according to the EU numbering system, also called the EU index, as described in Kabat et al., *Sequences of Proteins of Immunological Interest,* 5th Ed. Public Health Service, National Institutes of Health, Bethesda, MD, 1991.

The term "Fc region-comprising antibody" refers to an antibody that comprises an Fc region. The C-terminal lysine (residue 447 according to the EU numbering system) or C-terminal glycine-lysine (residues 446-447) of the Fc region may be removed, for example, during purification of the antibody or by recombinant engineering of the nucleic acid encoding the antibody. Accordingly, a composition comprising an antibody having an Fc region according to this invention can comprise an antibody with G446-K447, with G446 and without K447, with all G446-K447 removed, or a mixture of three types of antibodies described above.

The term "variable region" or "variable domain" refers to the domain of an antibody heavy or light chain that is involved in binding the antibody to antigen. The variable domains of the heavy chain and light chain (VH and VL, respectively) of a native antibody generally have similar structures, with each domain comprising four conserved framework regions (FRs) and three hypervariable regions (HVRs) (See, e.g., Kindt et al., *Kuby Immunology,* 6$^{th}$ ed., W.H. Freeman and Co., page 91 (2007)). A single VH or VL domain may be sufficient to confer antigen-binding specificity. Furthermore, antibodies that bind a particular antigen may be isolated using a VH or VL domain from an antibody that binds the antigen to screen a library of complementary VL or VH domains, respectively. See, e.g., Portolano et al., *J. Immunol.* 150: 880-887 (1993); Clarkson et al., *Nature* 352: 624-628 (1991).

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1(L1)-FR2-H2(L2)-FR3-H3(L3)-FR4.

The terms "full length antibody," "intact antibody," and "whole antibody" are used herein interchangeably to refer to an antibody having a structure substantially similar to a native antibody structure or having heavy chains that contain an Fc region as defined herein.

A "functional Fc region" possesses an "effector function" of a native sequence Fc region. Exemplary "effector functions" include C1q binding; CDC; Fc receptor binding;

ADCC; phagocytosis; down regulation of cell surface receptors (e.g., B cell receptor; BCR), etc. Such effector functions generally require the Fc region to be combined with a binding domain (e.g., an antibody variable domain) and can be assessed using various assays as disclosed, for example, in definitions herein.

A "human antibody" is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

A "human consensus framework" is a framework which represents the most commonly occurring amino acid residues in a selection of human immunoglobulin VL or VH framework sequences. Generally, the selection of human immunoglobulin VL or VH sequences is from a subgroup of variable domain sequences. Generally, the subgroup of sequences is a subgroup as in Kabat et al., *Sequences of Proteins of Immunological Interest*, Fifth Edition, NIH Publication 91-3242, Bethesda MD (1991), vols. 1-3. In one embodiment, for the VL, the subgroup is subgroup κI as in Kabat et al., supra. In one embodiment, for the VH, the subgroup is subgroup III as in Kabat et al., supra.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization.

The term "hypervariable region" or "HVR" as used herein refers to each of the regions of an antibody variable domain which are hypervariable in sequence ("complementarity determining regions" or "CDRs") and/or form structurally defined loops ("hypervariable loops") and/or contain the antigen-contacting residues ("antigen contacts"). Generally, antibodies comprise six HVRs: three in the VH (H1, H2, H3), and three in the VL (L1, L2, L3). Exemplary HVRs herein include:
  (a) hypervariable loops occurring at amino acid residues 26-32 (L1), 50-52 (L2), 91-96 (L3), 26-32 (H1), 53-55 (H2), and 96-101 (H3) (Chothia and Lesk, J. Mol. Biol. 196:901-917 (1987));
  (b) CDRs occurring at amino acid residues 24-34 (L1), 50-56 (L2), 89-97 (L3), 31-35b (H1), 50-65 (H2), and 95-102 (H3) (Kabat et al., Sequences of Proteins of Immunological Interest, 5th Ed. Public Health Service, National Institutes of Health, Bethesda, MD (1991));
  (c) antigen contacts occurring at amino acid residues 27c-36 (L1), 46-55 (L2), 89-96 (L3), 30-35b (H1), 47-58 (H2), and 93-101 (H3) (MacCallum et al., J. Mol. Biol. 262:732-745 (1996)); and
  (d) combinations of (a), (b), and/or (c), including HVR amino acid residues 46-56 (L2), 47-56 (L2), 48-56 (L2), 49-56 (L2), 26-35 (H1), 26-35b (H1), 49-65 (H2), 93-102 (H3), and 94-102 (H3).

Unless otherwise indicated, HVR residues and other residues in the variable domain (e.g., FR residues) are numbered herein according to Kabat et al., supra.

An "immunoconjugate" is an antibody conjugated to one or more heterologous molecule(s), including but not limited to a cytotoxic agent.

An "isolated" antibody is one which has been separated from a component of its natural environment. In some embodiments, an antibody is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of antibody purity, see, e.g., Flatman et al., *J. Chromatogr. B* 848: 79-87 (2007).

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

"Isolated nucleic acid encoding an antibody" refers to one or more nucleic acid molecules encoding antibody heavy and light chains (or fragments thereof), including such nucleic acid molecule(s) in a single vector or separate vectors, and such nucleic acid molecule(s) present at one or more locations in a host cell.

Herein, "first polypeptide" and "second polypeptide" mean polypeptides constituting an antibody Fc region. The terms "first polypeptide" and "second polypeptide" mean that their sequences are different from each other, and preferably at least the CH2 domain sequences are different. Further, the CH3 domain sequences may also be different. The polypeptides may be, for example, polypeptides that constitute the Fc region of a naturally-occurring (native) IgG, or polypeptides produced by altering the polypeptides constituting the Fc region of a naturally-occurring (native) IgG.

"Native IgGs" refers to polypeptides that belong to a class of antibodies practically encoded by immunoglobulin gamma genes and comprise an amino acid sequence identical to those of IgGs found in nature. For example, a native human IgG refers to a native human IgG1, native human IgG2, native human IgG3, native human IgG4, or such. Native IgGs also include mutants spontaneously produced from them.

"Polypeptides" of the present invention generally refers to peptides or proteins approximately ten amino acids or more in length. Furthermore, they are generally polypeptides derived from organisms, but are not particularly limited, and for example, they may be polypeptides comprising an artificially designed sequence. Furthermore, they may be any of naturally-occurring polypeptides, synthetic polypeptides, recombinant polypeptides, or such. Protein molecules of the present invention refer to molecules comprising the polypeptide.

Preferred examples of the polypeptides of the present invention include antibodies. More preferred examples include native IgGs and antibodies resulting from modification introduced into native IgGs. Examples of the native IgGs include, in particular, native human IgGs. "Native IgGs" refers to polypeptides belonging to a class of antibodies practically encoded by immunoglobulin gamma genes and comprising an amino acid sequence identical to those of IgGs found in nature. For example, a native human IgG means a native human IgG1, native human IgG2, native human IgG3, native human IgG4, or such. Native IgGs also include mutants spontaneously produced from them.

The term "polypeptide comprising an Fc region" is not particularly limited as long as it is a polypeptide that comprises an Fc region. For example, it is an antibody that comprises an Fc region. The C-terminal lysine (residue 447 according to the EU numbering system) or C-terminal glycine-lysine (residues 446-447) of the Fc region may be removed, for example, during purification of the polypeptide (e.g. antibody) or by recombinant engineering of the nucleic acid encoding the polypeptide. Accordingly, a composition comprising a polypeptide having an Fc region according to this invention can comprise a polypeptide comprising an Fc region with G446-K447, a polypeptide comprising an Fc region with G446 and without K447, a polypeptide comprising an Fc region with all G446-K447 removed, or a mixture of three types of polypeptides described above.

An "isolated" polypeptide is one which has been separated from a component of its natural environment. In some embodiments, a polypeptide is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of polypeptide purity, see, e.g., Flatman et al., *J. Chromatogr. B* 848: 79-87 (2007).

"Isolated nucleic acid encoding a polypeptide" refers to one or more nucleic acid molecules encoding the polypeptide (e.g. antibody Fc region or antibody heavy and light chains or fragments thereof), including such nucleic acid molecule(s) in a single vector or separate vectors, and such nucleic acid molecule(s) present at one or more locations in a host cell.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors." Vectors can be introduced into host cells by methods using virus or electroporation methods. Introduction of vectors is not limited to ex vivo introduction, and it is possible to introduce vectors directly in vivo.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

The term "monoclonal antibody" as used herein refers to an antibody obtained from a population of substantially homogeneous antibodies, i.e., the individual antibodies composing the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including but not limited to the hybridoma method, recombinant DNA methods, phage-display methods, and methods utilizing transgenic animals containing all or part of the human immunoglobulin loci, such methods and other exemplary methods for making monoclonal antibodies being described herein.

A "naked antibody" refers to an antibody that is not conjugated to a heterologous moiety (e.g., a cytotoxic moiety) or radiolabel. The naked antibody may be present in a pharmaceutical formulation.

"Native antibodies" refer to naturally occurring immunoglobulin molecules with varying structures. For example, native IgG antibodies are heterotetrameric glycoproteins of about 150,000 daltons, composed of two identical light chains and two identical heavy chains that are disulfide-bonded. From N- to C-terminus, each heavy chain has a variable region (VH), also called a variable heavy chain domain or a heavy chain variable domain, followed by three constant domains (CH1, CH2, and CH3). Similarly, from N- to C-terminus, each light chain has a variable region (VL), also called a variable light chain domain or a light chain variable domain, followed by a constant light chain (CL) domain. The light chain of an antibody may be assigned to one of two types, called kappa (κ) and lambda (λ), based on the amino acid sequence of its constant domain.

A "native sequence Fc region" comprises an amino acid sequence identical to the amino acid sequence of an Fc region found in nature. Native sequence human Fc regions include a native sequence human IgG1 Fc region (non-A and A allotypes): native sequence human IgG2 Fc region: native sequence human IgG3 Fc region; and native sequence human IgG4 Fc region as well as naturally occurring variants thereof.

A "variant Fc region" comprises an amino acid sequence which differs from that of a native sequence Fc region by virtue of at least one amino acid modification (alteration), preferably one or more amino acid substitution(s). Preferably, the variant Fc region has at least one amino acid substitution compared to a native sequence Fc region or to the parent Fc region, e.g., from about 1 to about 30 amino acid substitutions, preferably from about 1 to about 20 amino acid substitutions, more preferably from about 1 to about 10 amino acid substitutions, and most preferably from about 1 to about 5 amino acid substitutions in a native sequence Fc region or in the parent Fc region. The variant Fc region herein preferably possesses at least about 80% homology with a native sequence Fc region or with a parent Fc region, preferably at least about 85% homology therewith, more preferably at least about 90% homology therewith, and most preferably at least about 95% homology therewith.

"Percent (%) amino acid sequence identity" with respect to a reference polypeptide sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN, Megalign (DNASTAR) software, or GENETYX (registered trademark) (Genetyx Co., Ltd.). Those skilled in the art can determine appropriate parameters for aligning sequences, including any algorithms needed to achieve maximal alignment over the full length of the sequences being compared.

The ALIGN-2 sequence comparison computer program was authored by Genentech, Inc., and the source code has been filed with user documentation in the U.S. Copyright Office, Washington D.C., 20559, where it is registered under U.S. Copyright Registration No. TXU510087. The ALIGN-2 program is publicly available from Genentech, Inc., South San Francisco, California, or may be compiled from the source code. The ALIGN-2 program should be compiled for use on a UNIX operating system, including digital UNIX V4.0D. All sequence comparison parameters are set by the ALIGN-2 program and do not vary. In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction $X/Y$ where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

The terms "pharmaceutical formulation" and "pharmaceutical composition" are used interchangeably to refer to a preparation which is in such form as to permit the biological activity of an active ingredient contained therein to be effective, and which contains no additional components which are unacceptably toxic to a subject to which it would be administered.

An "individual" or "subject" is a mammal. Mammals include, but are not limited to, domesticated animals (e.g., cows, sheep, cats, dogs, and horses), primates (e.g., humans and non-human primates such as monkeys), rabbits, and rodents (e.g., mice and rats). In certain embodiments, the individual or subject is a human.

A "pharmaceutically acceptable carrier" refers to an ingredient in a pharmaceutical formulation or pharmaceutical composition, other than an active ingredient, which is nontoxic to a subject. A pharmaceutically acceptable carrier includes, but is not limited to, a buffer, excipient, stabilizer, or preservative.

An "effective amount" of an agent, e.g., a pharmaceutical formulation, refers to an amount effective, at dosages and for periods of time necessary, to achieve the desired therapeutic or prophylactic result.

The term "package insert" is used to refer to instructions customarily included in commercial packages of therapeutic products, that contain information about the indications, usage, dosage, administration, combination therapy, contraindications and/or warnings concerning the use of such therapeutic products.

The term "CTLA-4," as used herein, refers to any native CTLA-4 from any vertebrate source, including mammals such as primates (e.g., humans) and rodents (e.g., mice and rats), unless otherwise indicated. The term encompasses "full-length" unprocessed CTLA-4 as well as any form of CTLA-4 that results from processing in the cell. The term also encompasses naturally occurring variants of CTLA-4, e.g., splice variants or allelic variants. The amino acid sequence of an exemplary human CTLA-4 is shown in SEQ ID NO: 214, the amino acid sequence of a mouse CTLA-4 is shown in SEQ ID NO: 247, the amino acid sequence of a monkey CTLA-4 is shown in SEQ ID NO: 248, and the amino acid sequence of a human CTLA-4 extracellular domain is shown in SEQ ID NO: 28. Herein, CTLA-4 may also be described as CTLA4.

The term "regulatory T (Treg) cells" refers to a subpopulation of T cells that regulate the immune system, maintain tolerance to autoantigens, and suppress autoimmune diseases. These cells generally suppress or downregulate the induction and proliferation of effector T cells. The best understood Treg cells are those expressing CD4, CD25, and Foxp3 ($CD4^+$ $CD25^+$ Treg cells). These Treg are different from helper T cells. Several different methods are used for identifying and monitoring Treg cells. When defined by CD4 and CD25 expression ($CD4^+$ $CD25^+$ cells), Treg cells constitute about 5% to about 10% of mature $CD4^+$ T cell subpopulation in mice and humans, while about 1% to about 2% of Treg can be measured in whole blood. The identification and monitoring may be performed by further measuring Foxp3 expression ($CD4^+$ $CD25^+$ $Foxp3^+$ cells). Furthermore, as another marker, the absence or low-level expression of CD127 may be used in combination with the presence of CD4 and CD25. Treg cells also express high levels of CTLA-4 and GITR. Treg can also be identified by the methods described in Examples below.

The term "substantially similar," "substantially equal," or "substantially the same," as used herein, refers to a sufficiently high degree of similarity between two numeric values (for example, one associated with an antibody of the present invention and the other associated with a reference/comparator antibody), such that one skilled in the art would consider the difference between the two values to be of little or no biological and/or statistical significance within the context of the biological characteristic measured by said values (e.g., KD values).

As used herein, "treatment" (and grammatical variations thereof such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, antibodies of the present invention are used to delay development of a disease or to slow the progression of a disease. In some embodiments, polypeptides comprising a variant Fc region of the present invention are used to delay development of a disease or to slow the progression of a disease.

The term "tumor" refers to all neoplastic cell growth and proliferation, whether malignant or benign, and all precancerous and cancerous cells and tissues. The terms "cancer," "cancerous," "cell proliferative disorder," "proliferative disorder" and "tumor" are not mutually exclusive as referred to herein.

The term "tumor tissue" means a tissue comprising at least one tumor cell. Tumor tissue is usually composed of a population of tumor cells that form the main entity of the tumor (parenchyma) and connective tissues and blood vessels that exist between these cells and support the tumor ("stroma"). The distinction between the two is clear in some cases, while in others they are intermingled. Tumor tissues may be infiltrated by immune cells and the like. On the other hand, a "non-tumor tissue" means a tissue other than a tumor tissue(s) in a living organism. Healthy/normal tissues that are not in a diseased state are typical examples of non-tumor tissues.

II. Compositions and Methods

In one aspect, the present invention is based, in part, on anti-CTLA-4 antibodies and uses thereof. In certain embodiments, antibodies that bind to CTLA-4 are provided. Antibodies of the present invention are useful, e.g., for the diagnosis or treatment of cancer.

A. Exemplary Anti-CTLA-4 Antibodies

In one aspect, the present invention provides isolated antibodies that bind to CTLA-4. In certain embodiments, an anti-CTLA-4 antibody of the present invention has CTLA-4-binding activity dependent on the concentration of an adenosine-containing compound. In some embodiments, binding activity to CTLA-4 is higher in the presence of an adenosine-containing compound compared to that in the absence of the adenosine-containing compound. In another embodiment, binding activity to CTLA-4 is higher in the presence of high concentration of an adenosine-containing compound compared to that in the presence of low concentration of the adenosine-containing compound. In further embodiments, the difference of binding activity to CTLA-4 is, for example, twice or more, 3 times or more, 5 times or more, 10 times or more, 20 times or more, 30 times or more, 50 times or more, 100 times or more, 200 times or more, 300 times or more, 500 times or more, $1 \times 10^3$ times or more, $2 \times 10^3$ times or more, $3 \times 10^3$ times or more, $5 \times 10^3$ times or more, $1 \times 10^4$ times or more, $2 \times 10^4$ times or more, $3 \times 10^4$ times or more, $5 \times 10^4$ times or more, or $1 \times 10^5$ times or more.

In some embodiments, the binding activity of the anti-CTLA-4 antibody can be represented by a KD (dissociation constant) value. In a further embodiment, the KD value of the anti-CTLA-4 antibody in the presence of an adenosine-containing compound is smaller than that in the absence of the adenosine-containing compound. Alternatively, in another embodiment, the KD value of the anti-CTLA-4 antibody in the presence of a high concentration of an adenosine-containing compound is smaller than that in the presence of a low concentration of the adenosine-containing compound. In a further embodiment, the difference in the KD values of the anti-CTLA-4 antibody is, for example, twice or more, 3 times or more, 5 times or more, 10 times or more, 20 times or more, 30 times or more, 50 times or more, 100 times or more, 200 times or more, 300 times or more, 500 times or more, $1 \times 10^3$ times or more, $2 \times 10^3$ times or more, $3 \times 10^3$ times or more, $5 \times 10^3$ times or more, $1 \times 10^4$ times or more, $2 \times 10^4$ times or more, $3 \times 10^4$ times or more, $5 \times 10^4$ times or more, or $1 \times 10^5$ times or more. The KD values of the anti-CTLA-4 antibodies in the presence of an adenosine-containing compound or in the presence of a high concentration of an adenosine-containing compound can be, for example, $9 \times 10^{-7}$ M or less, $8 \times 10^{-7}$ M or less, $7 \times 10^{-7}$ M or less, $6 \times 10^{-7}$ M or less, $5 \times 10^{-7}$ M or less, $4 \times 10^{-7}$ M or less, $3 \times 10^{-7}$ M or less, $2 \times 10^{-7}$ M or less, $1 \times 10^{-7}$ M or less, $9 \times 10^{-8}$ M or less, $8 \times 10^{-8}$ M or less, $7 \times 10^{-8}$ M or less, $6 \times 10^{-8}$ M or less, $5 \times 10^{-8}$ M or less, $4 \times 10^{-8}$ M or less, $3 \times 10^{-8}$ M or less, $2 \times 10^{-8}$ M or less, $1 \times 10^{-8}$ M or less, $9 \times 10^{-9}$ M or less, $8 \times 10^{-9}$ M or less, $7 \times 10^{-9}$ M or less, $6 \times 10^{-9}$ M or less, $5 \times 10^{-9}$ M or less, $4 \times 10^{-9}$ M or less, $3 \times 10^{-9}$ M or less, $2 \times 10^{-9}$ M or less, $1 \times 10^{-9}$ M or less, $9 \times 10^{-10}$ M or less, $8 \times 10^{-10}$ M or less, $7 \times 10^{-10}$ M or less, $6 \times 10^{-10}$ M or less, $5 \times 10^{-10}$ M or less, $4 \times 10^{-10}$ M or less, $3 \times 10^{-10}$ M or less, $2 \times 10^{-10}$ M or less, or $1 \times 10^{-10}$ M or less. The KD values of the anti-CTLA-4 antibodies in the absence of an adenosine-containing compound or in the presence of a low concentration of an adenosine-containing compound can be, for example, $1 \times 10^{-8}$ M or more, $2 \times 10^{-8}$ M or more, $3 \times 10^{-8}$ M or more, $4 \times 10^{-8}$ M or more, $5 \times 10^{-8}$ M or more, $6 \times 10^{-8}$ M or more, $7 \times 10^{-8}$ M or more $8 \times 10^{-8}$ M or more, $9 \times 10^{-8}$ M or more, $1 \times 10^{-7}$ M or more, $2 \times 10^{-7}$ M or more, $3 \times 10^{-7}$ M or more, $4 \times 10^{-7}$ M or more, $5 \times 10^{-7}$ M or more, $6 \times 10^{-7}$ M or more, $7 \times 10^{-7}$ M or more, $8 \times 10^{-7}$ M or more, $9 \times 10^{-7}$ M or more, $1 \times 10^{-6}$ M or more, $2 \times 10^{-6}$ M or more $3 \times 10^{-6}$ M or more, $4 \times 10^{-6}$ M or more, $5 \times 10^{-6}$ M or more, $6 \times 10^{-6}$ M or more, $7 \times 10^{-6}$ M or more, $8 \times 10^{-6}$ M or more, or $9 \times 10^{-6}$ M or more.

In another embodiment, the binding activity of the anti-CTLA-4 antibody may be represented by a kd (dissociation rate constant) value instead of a KD value.

In another embodiment, the binding activity of the anti-CTLA-4 antibody may be represented by the binding amount of CTLA-4 per unit amount of the antibody. For example, in a surface plasmon resonance assay, the binding amount of an antibody immobilized onto a sensor chip and the binding amount of an antigen further bound thereto are each measured as a resonance unit (RU). The value obtained by dividing the binding amount of the antigen by the binding amount of the antibody can be defined as the binding amount of the antigen per unit amount of the antibody. Specific methods for measuring and calculating such binding amounts are described in Examples below. In some embodiments, the binding amount of CTLA-4 in the presence of an adenosine-containing compound is greater than that in the absence of the adenosine-containing compound. Alternatively, in another embodiment, the binding amount of CTLA-4 in the presence of a high concentration of an adenosine-containing compound is greater than that in the presence of a low concentration of the adenosine-containing compound. In a further embodiment, the difference in the binding amount of CTLA-4 is, for example, twice or more, 3 times or more, 5 times or more, 10 times or more, 20 times or more, 30 times or more, 50 times or more, 100 times or more, 200 times or more, 300 times or more, 500 times or more, $1 \times 10^3$ times or more, $2 \times 10^3$ times or more, $3 \times 10^3$ times or more, $5 \times 10^3$ times or more, $1 \times 10^4$ times or more, $2 \times 10^4$ times or more, $3 \times 10^4$ times or more, $5 \times 10^4$ times or more, or $1 \times 10^5$ times or more. The value of the binding amount of CTLA-4 in the presence of an adenosine-containing compound or in the presence of a high concentration of the adenosine-containing compound can be, for example, 0.01 or more, 0.02 or more, 0.03 or more, 0.04 or more, 0.05 or more, 0.06 or more, 0.07 or more, 0.08 or more, 0.09 or more, 0.1 or more, 0.2 or more, 0.3 or more, 0.4 or more, 0.5 or more, 0.6 or more, 0.7 or more, 0.8 or more, 0.9 or more, or 1 or more. The value of the binding amount of CTLA-4 in the absence of an adenosine-containing compound or in the presence of a low concentration of the adenosine-containing compound can be, for example, 0.5 or less, 0.4 or less, 0.3 or less, 0.2 or less, 0.1 or less, 0.09 or less, 0.08 or less, 0.07 or less, 0.06 or less, 0.05 or less, 0.04 or less, 0.03 or less, 0.02 or less, 0.01 or less, 0.009 or less, 0.008 or less, 0.007 or less, 0.006 or less, 0.005 or less, 0.004 or less, 0.003 or less, 0.002 or less, or 0.001 or less.

In some embodiments, the KD values, kd values, values of binding amount and such described herein are measured or calculated by performing a surface plasmon resonance assay at 25° C. or 37° C. (see, for example, Reference Example 3 herein).

Any concentration of an adenosine-containing compound can be selected as long as a difference in the binding activity of an anti-CTLA-4 antibody is detected. In certain embodiments, a high concentration can include, for example, 1 nM or higher than 1 nM, 3 nM or higher than 3 nM, 10 nM or higher than 10 nM, 30 nM or higher than 30 nM, 100 nM or higher than 100 nM, 300 nM or higher than 300 nM, 1 µM or higher than 1µ, 3µ M or higher than 3µ, 10µ M or higher than 10µ M, 30 µM or higher than 30 µM, 100 µM or higher than 100 µM, 300 µM or higher than 300 µM, 1 mM or higher than 1 mM, 3 mM or higher than 3 mM, 10 mM or higher than 10 mM, 30 mM or higher than 30 mM, 100 mM or higher than 100 mM, 300 mM or higher than 300 mM, and 1 M or higher than 1 M. Alternatively, the high concentration here can be a sufficient amount at which respective anti-CTLA-4 antibody shows maximum binding activity. In one embodiment, 1 µM, 10 µM, 100 µM, 1 mM, or a sufficient amount at which respective anti-CTLA-4 antibody shows maximum binding activity can be selected as the high concentration here. In certain embodiments, a low concentration can include, for example, 1 mM or lower than 1 mM, 300 µM or lower than 300 µM, 100 µM or lower than 100 µM, 30 µM or lower than 30 µM, 10 µM or lower than 10 µM, 3 µM or lower than 3 µM, 1 µM or lower than 1 µM, 300 nM or lower than 300 nM, 100 nM or lower than 100 nM, 30 nM or lower than 30 nM, 10 nM or lower than 10 nM, 3 nM or lower than 3 nM, 1 nM or lower than 1 nM, 300 pM or lower than 300 pM, 100 pM or lower than 100 pM, 30 pM or lower than 30 pM, 10 pM or lower than 10 pM, 3 pM or lower than 3 pM, and 1 pM or lower than 1 pM. Alternatively, the low concentration here can be a concentration at which respective anti-CTLA-4 antibody shows minimum binding activity. The case where the substantial concentration is zero (in the absence of an adenosine-containing compound) can also be selected as an embodiment of low concentration. In one embodiment, 1 mM, 100 µM, 10 µM, 1 µM, the concentration at which respective anti-CTLA-4 antibody shows minimum binding activity, or the absence of an adenosine compound can be selected as the lower concentration here. In another embodiment, the following values can be selected as the ratio of high concentration to low concentration: for example, 3 times or more, 10 times or more, 30 times or more, 100 times or more, 300 times or more, $1 \times 10^3$ times or more, $3 \times 10^3$ times or more, $1 \times 10^4$ times or more, $3 \times 10^4$ times or more, $1 \times 10^5$ times or more, $3 \times 10^5$ times or more, $1 \times 10^6$ times or more, $3 \times 10^6$ times or more, $1 \times 10^7$ times or more, $3 \times 10^7$ times or more, $1 \times 10^8$ times or more, $3 \times 10^8$ times or more, $1 \times 10^9$ times or more, $3 \times 10^9$ times or more, $1 \times 10^{10}$ times or more, $3 \times 10^{10}$ times or more, $1 \times 10^{11}$ times or more, $3 \times 10^{11}$ times or more, or $1 \times 10^{12}$ times or more.

In another embodiment, the anti-CTLA-4 antibodies of the present invention have binding activity also to adenosine-containing compounds. The binding amount of an adenosine-containing compound per unit amount of an anti-CTLA-4 antibody can be calculated using the above-mentioned method and used as the binding activity of the antibody to the adenosine-containing compound. Specific methods for measuring and calculating such binding amounts are described in Examples below. The value of the binding amount of an adenosine-containing compound per unit amount of an anti-CTLA-4 antibody of the present invention can be, for example, 0.0001 or more, 0.0002 or more, 0.0003 or more, 0.0004 or more, 0.0005 or more, 0.0006 or more, 0.0007 or more, 0.0008 or more, 0.0009 or more, 0.001 or more, 0.002 or more, 0.003 or more, 0.004 or more, 0.005 or more, 0.006 or more, 0.007 or more, 0.008 or more, 0.009 or more, or 0.01 or more.

In another embodiment, the anti-CTLA-4 antibodies of the present invention form a ternary complex with an adenosine-containing compound and CTLA-4. In one embodiment, the anti-CTLA-4 antibody binds to an adenosine-containing compound through the heavy chain CDR1, CDR2, and CDR3. In one embodiment, the anti-CTLA-4 antibody has a binding motif for an adenosine-containing compound. The binding motif for an adenosine-containing compound can be composed of, for example, at least one amino acid present at positions 33, 52, 52a, 53, 56, 58, 95, 96, 100a, 100b, and 100c according to Kabat numbering. In a further embodiment, the anti-CTLA-4 antibody binds to an adenosine-containing compound, for example, through at least one amino acid selected from the group consisting of positions 33, 52, 52a, 53, 56, 58, 95, 96, 100a, 100b, and 100c according to Kabat numbering. In certain embodiments, the anti-CTLA-4 antibodies have at least one amino acid selected from the group consisting of Thr at position 33, Ser at position 52, Ser at position 52a, Arg at position 53, Tyr at position 56, Tyr at position 58, Tyr at position 95, Gly at position 96, Met at position 100a, Leu at position 100b, and Trp at position 100c, according to Kabat numbering. CTLA-4 may further bind to the complex formed by the binding of an anti-CTLA-4 antibody and an adenosine-containing compound. Moreover, the adenosine-containing compound may be present at the interface where the anti-CTLA-4 antibody and CTLA-4 interact and may bind to both of them. It can be confirmed by techniques such as crystal structure analysis described below that the anti-CTLA-4 antibody forms a ternary complex with an adenosine-containing compound and CTLA-4 (see Examples).

In another embodiment, the anti-CTLA-4 antibodies of the present invention bind to at least one amino acid selected from the group consisting of the amino acids at position 3 (Met), position 33 (Glu), position 35 (Arg), position 53 (Thr), position 97 (Glu), position 99 (Met), position 100 (Tyr), position 101 (Pro), position 102 (Pro), position 103 (Pro), position 104 (Tyr), position 105 (Tyr), and position 106 (Leu) of the human CTLA-4 (extracellular domain; SEQ ID NO: 28). These amino acids can constitute an epitope of the anti-CTLA-4 antibody of the present invention. In another embodiment, the anti-CTLA-4 antibodies of the present invention bind to the region from the amino acid at position 97 (Glu) to the amino acid at position 106 (Leu) of human CTLA-4 (extracellular domain; SEQ ID NO: 28). In another embodiment, the anti-CTLA-4 antibodies of the present invention bind to the region from the amino acid at position 99 (Met) to the amino acid at position 106 (Leu) of human CTLA-4 (extracellular domain; SEQ ID NO: 28).

In another embodiment, the anti-CTLA-4 antibodies of the present invention compete with ABAM004 (VH, SEQ ID NO: 10; VL, SEQ ID NO: 11; HVR-H1, SEQ ID NO: 100; HVR-H2, SEQ ID NO: 101; HVR-H3, SEQ ID NO: 102; HVR-L1, SEQ ID NO: 113; HVR-L2, SEQ ID NO: 114; HVR-L3, SEQ ID NO: 115) for binding to CTLA-4. In another embodiment, the anti-CTLA-4 antibodies of the present invention bind to the same epitope as that of ABAM004. When there is an excess of anti-CTLA-4 antibodies, the binding of ABAM004 to CTLA-4 can be reduced by, for example, 10% or more, 15% or more, 20% or more, 25% or more, 30% or more, 35% or more, 40% or more, 45% or more, 50% or more, 55% or more, 60% or more, 65% or more, 70% or more, 75% or more, 80% or more, 85% or more, 90% or more, or 95% or more. Exemplary competitive assays are herein provided.

In another embodiment, the anti-CTLA-4 antibodies of the present invention show cytotoxic activity against CTLA-4-expressing cells. When CTLA-4 is expressed on the surface of a target cell and an anti-CTLA-4 antibody binds to it, the cell can be damaged. The damage to the cell may be caused by effector cells bound to the antibody, such as antibody-dependent cellular cytotoxicity (ADCC) activity and antibody-dependent cellular phagocytosis (ADCP) activity, or it may be caused by complements bound to the antibody, such as complement-dependent cytotoxicity (CDC) activity. Alternatively, the damage may be caused by a cytotoxic agent (e.g., a radioisotope or chemotherapeutic agent) conjugated to the antibody, such as an immunoconjugate. The cytotoxicity here can include the effects of inducing cell death, suppressing cell proliferation, and impairing cell functions. When an anti-CTLA-4 antibody is present in a sufficient amount, it can cause damage to, for example, 10% or more, 15% or more, 20% or more, 25% or more, 30% or more, 35% or more, 40% or more, 45% or more, 50% or more, 55% or more, 60% or more, 65% or more, 70% or more, 75% or more, 80% or more, 85% or more, 90% or more, or 95% or more of CTLA-4-expressing cells. The measurement of such cytotoxic activity can be performed comparing it to the measurement in the absence of the antibody or in the presence of a negative control antibody. Exemplary cytotoxicity assays are herein provided.

In another embodiment, the anti-CTLA-4 antibodies of the present invention show neutralizing activity against CTLA-4. CTLA-4 is known to function by interacting with its ligand, CD80 (B7-1) or CD86 (B7-2). In certain embodiments, the anti-CTLA-4 antibodies inhibit the interaction of CTLA-4 with CD80 (B7-1) or CD86 (B7-2). When an anti-CTLA-4 antibody is present in a sufficient amount, it can inhibit the interaction of CTLA-4 with CD80 (B7-1) or CD86 (B7-2) by, for example, 10% or more, 15% or more, 20% or more, 25% or more, 30% or more, 35% or more, 40% or more, 45% or more, 50% or more, 55% or more, 60% or more, 65% or more, 70% or more, 75% or more, 80% or more, 85% or more, 90% or more, or 95% or more. The measurement of such inhibitory activity can be performed comparing it to the measurement in the absence of the antibody or in the presence of a negative control antibody. Specific methods of measuring neutralizing activity are herein provided.

In another embodiment, the anti-CTLA-4 antibodies of the present invention bind to CTLA-4 derived from multiple animal species. Exemplary animal species can include mammals, for example, humans, monkeys, mice, rats, hamsters, guinea pigs, rabbits, pigs, cattle, goats, horses, sheep, camels, dogs, and cats. In certain embodiments, the anti-CTLA-4 antibodies bind to CTLA-4 derived from humans and non-humans (e.g., monkeys, mice, and rats). The amino acid sequence of the human CTLA-4 is shown in SEQ ID NO: 214, the amino acid sequence of the simian CTLA-4 is shown in SEQ ID NO: 247, and the amino acid sequence of the murine CTLA-4 is shown in SEQ ID NO: 248. The amino acid sequences of CTLA-4 derived from other animal species can also be appropriately determined by methods known to those skilled in the art.

In certain embodiments, the adenosine-containing compounds in the present invention can include, for example, adenosine (ADO), adenosine triphosphate (ATP), adenosine diphosphate (ADP), adenosine monophosphate (AMP), cyclic adenosine monophosphate (cAMP), deoxyadenosine (dADO), deoxyadenosine triphosphate (dATP), deoxyadenosine diphosphate (dADP), deoxyadenosine monophosphate (dAMP), and adenosine (γ-thio) triphosphate (ATPγS).

In one aspect, the present invention provides an antibody comprising at least one, at least two, or all three VH HVR sequences selected from (a) HVR-H1 comprising the amino acid sequence of SEQ ID NO: 223; (b) HVR-H2 comprising the amino acid sequence of SEQ ID NO: 224; and (c) HVR-H3 comprising the amino acid sequence of SEQ ID NO: 225. In one embodiment, the antibody comprises (a) HVR-H1 comprising the amino acid sequence of SEQ ID NO: 223; (b) HVR-H2 comprising the amino acid sequence of SEQ ID NO: 224; and (c) HVR-H3 comprising the amino acid sequence of SEQ ID NO: 225.

In another aspect, the present invention provides an antibody comprising at least one, at least two, or all three VL HVR sequences selected from (a) HVR-L1 comprising the amino acid sequence of SEQ ID NO: 226; (b) HVR-L2 comprising the amino acid sequence of SEQ ID NO: 227; and (c) HVR-L3 comprising the amino acid sequence of SEQ ID NO: 228. In one embodiment, the antibody comprises (a) HVR-L1 comprising the amino acid sequence of SEQ ID NO: 226; (b) HVR-L2 comprising the amino acid sequence of SEQ ID NO: 227; and (c) HVR-L3 comprising the amino acid sequence of SEQ ID NO: 228.

In another aspect, an antibody of the present invention comprises (a) a VH domain comprising at least one, at least two, or all three VH HVR sequences selected from (i) HVR-H1 comprising the amino acid sequence of SEQ ID NO: 223, (ii) HVR-H2 comprising the amino acid sequence of SEQ ID NO: 224, and (iii) HVR-H3 comprising an amino acid sequence of SEQ ID NO: 225; and (b) a VL domain comprising at least one, at least two, or all three VL HVR sequences selected from (i) HVR-L1 comprising the amino acid sequence of SEQ ID NO: 226, (ii) HVR-L2 comprising the amino acid sequence of SEQ ID NO: 227, and (iii) HVR-L3 comprising the amino acid sequence of SEQ ID NO: 228.

In another aspect, the present invention provides an antibody comprising (a) HVR-H1 comprising the amino acid sequence of SEQ ID NO: 223; (b) HVR-H2 comprising the amino acid sequence of SEQ ID NO: 224; (c) HVR-H3 comprising the amino acid sequence of SEQ ID NO: 225; (d) HVR-L1 comprising the amino acid sequence of SEQ ID NO: 226; (e) HVR-L2 comprising the amino acid sequence of SEQ ID NO: 227; and (f) HVR-L3 comprising the amino acid sequence of SEQ ID NO: 228.

In one aspect, the present invention provides an antibody comprising at least one, at least two, or all three VH HVR sequences selected from (a) HVR-H1 comprising the amino acid sequence of SEQ ID NO: 100; (b) HVR-H2 comprising the amino acid sequence of SEQ ID NO: 101; and (c) HVR-H3 comprising the amino acid sequence of SEQ ID NO: 102. In one embodiment, the antibody comprises (a) HVR-H1 comprising the amino acid sequence of SEQ ID NO: 100; (b) HVR-H2 comprising the amino acid sequence of SEQ ID NO: 101; and (c) HVR-H3 comprising the amino acid sequence of SEQ ID NO: 102.

In another aspect, the present invention provides an antibody comprising at least one, at least two, or all three VL HVR sequences selected from (a) HVR-L1 comprising the amino acid sequence of SEQ ID NO: 113; (b) HVR-L2 comprising the amino acid sequence of SEQ ID NO: 114; and (c) HVR-L3 comprising the amino acid sequence of SEQ ID NO: 115. In one embodiment, the antibody comprises (a) HVR-L1 comprising the amino acid sequence of SEQ ID NO: 113; (b) HVR-L2 comprising the amino acid sequence of SEQ ID NO: 114; and (c) HVR-L3 comprising the amino acid sequence of SEQ ID NO: 115.

In another aspect, an antibody of the present invention comprises (a) a VH domain comprising at least one, at least two, or all three VH HVR sequences selected from (i) HVR-H1 comprising the amino acid sequence of SEQ ID NO: 100, (ii) HVR-H2 comprising the amino acid sequence of SEQ ID NO: 101, and (iii) HVR-H3 comprising an amino acid sequence of SEQ ID NO: 102; and (b) a VL domain comprising at least one, at least two, or all three VL HVR sequences selected from (i) HVR-L1 comprising the amino acid sequence of SEQ ID NO: 113, (ii) HVR-L2 comprising the amino acid sequence of SEQ ID NO: 114, and (iii) HVR-L3 comprising the amino acid sequence of SEQ ID NO: 115.

In another aspect, the present invention provides an antibody comprising (a) HVR-H1 comprising the amino acid sequence of SEQ ID NO: 100; (b) HVR-H2 comprising the amino acid sequence of SEQ ID NO: 101; (c) HVR-H3 comprising the amino acid sequence of SEQ ID NO: 102; (d) HVR-L1 comprising the amino acid sequence of SEQ ID NO: 113; (e) HVR-L2 comprising the amino acid sequence of SEQ ID NO: 114; and (f) HVR-L3 comprising the amino acid sequence of SEQ ID NO: 115.

In one aspect, the present invention provides an antibody comprising at least one, at least two, or all three VH HVR sequences selected from (a) HVR-H1 comprising the amino acid sequence of SEQ ID NO: 100; (b) HVR-H2 comprising the amino acid sequence of SEQ ID NO: 104; and (c) HVR-H3 comprising the amino acid sequence of SEQ ID NO: 102. In one embodiment, the antibody comprises (a) HVR-H1 comprising the amino acid sequence of SEQ ID NO: 100; (b) HVR-H2 comprising the amino acid sequence of SEQ ID NO: 104; and (c) HVR-H3 comprising the amino acid sequence of SEQ ID NO: 102.

In another aspect, the present invention provides an antibody comprising at least one, at least two, or all three VL HVR sequences selected from (a) HVR-L1 comprising the amino acid sequence of SEQ ID NO: 116; (b) HVR-L2 comprising the amino acid sequence of SEQ ID NO: 117; and (c) HVR-L3 comprising the amino acid sequence of SEQ ID NO: 115. In one embodiment, the antibody comprises (a) HVR-L1 comprising the amino acid sequence of SEQ ID NO: 116; (b) HVR-L2 comprising the amino acid sequence of SEQ ID NO: 117; and (c) HVR-L3 comprising the amino acid sequence of SEQ ID NO: 115.

In another aspect, an antibody of the present invention comprises (a) a VH domain comprising at least one, at least two, or all three VH HVR sequences selected from (i) HVR-H1 comprising the amino acid sequence of SEQ ID NO: 100, (ii) HVR-H2 comprising the amino acid sequence of SEQ ID NO: 104, and (iii) HVR-H3 comprising an amino acid sequence of SEQ ID NO: 102; and (b) a VL domain comprising at least one, at least two, or all three VL HVR sequences selected from (i) HVR-L1 comprising the amino acid sequence of SEQ ID NO: 116, (ii) HVR-L2 comprising the amino acid sequence of SEQ ID NO: 117, and (iii) HVR-L3 comprising the amino acid sequence of SEQ ID NO: 115.

In another aspect, the present invention provides an antibody comprising (a) HVR-H1 comprising the amino acid sequence of SEQ ID NO: 100; (b) HVR-H2 comprising the amino acid sequence of SEQ ID NO: 104; (c) HVR-H3 comprising the amino acid sequence of SEQ ID NO: 102; (d) HVR-L1 comprising the amino acid sequence of SEQ ID NO: 116; (e) HVR-L2 comprising the amino acid sequence of SEQ ID NO: 117; and (f) HVR-L3 comprising the amino acid sequence of SEQ ID NO: 115.

In one aspect, the present invention provides an antibody comprising at least one, at least two, or all three VH HVR sequences selected from (a) HVR-H1 comprising the amino acid sequence of SEQ ID NO: 105; (b) HVR-H2 comprising the amino acid sequence of SEQ ID NO: 106; and (c) HVR-H3 comprising the amino acid sequence of SEQ ID NO: 102. In one embodiment, the antibody comprises (a) HVR-H1 comprising the amino acid sequence of SEQ ID NO: 105; (b) HVR-H2 comprising the amino acid sequence of SEQ ID NO: 106; and (c) HVR-H3 comprising the amino acid sequence of SEQ ID NO: 102.

In another aspect, the present invention provides an antibody comprising at least one, at least two, or all three VL HVR sequences selected from (a) HVR-L1 comprising the amino acid sequence of SEQ ID NO: 122; (b) HVR-L2 comprising the amino acid sequence of SEQ ID NO: 117; and (c) HVR-L3 comprising the amino acid sequence of SEQ ID NO: 133. In one embodiment, the antibody comprises (a) HVR-L1 comprising the amino acid sequence of SEQ ID NO: 122; (b) HVR-L2 comprising the amino acid sequence of SEQ ID NO: 117; and (c) HVR-L3 comprising the amino acid sequence of SEQ ID NO: 133.

In another aspect, an antibody of the present invention comprises (a) a VH domain comprising at least one, at least two, or all three VH HVR sequences selected from (i) HVR-H1 comprising the amino acid sequence of SEQ ID NO: 105, (ii) HVR-H2 comprising the amino acid sequence of SEQ ID NO: 106, and (iii) HVR-H3 comprising an amino acid sequence of SEQ ID NO: 102; and (b) a VL domain comprising at least one, at least two, or all three VL HVR sequences selected from (i) HVR-L1 comprising the amino acid sequence of SEQ ID NO: 122, (ii) HVR-L2 comprising the amino acid sequence of SEQ ID NO: 117, and (iii) HVR-L3 comprising the amino acid sequence of SEQ ID NO: 133.

In another aspect, the present invention provides an antibody comprising (a) HVR-H1 comprising the amino acid sequence of SEQ ID NO: 105; (b) HVR-H2 comprising the amino acid sequence of SEQ ID NO: 106; (c) HVR-H3 comprising the amino acid sequence of SEQ ID NO: 102; (d) HVR-L1 comprising the amino acid sequence of SEQ ID NO: 122; (e) HVR-L2 comprising the amino acid sequence of SEQ ID NO: 117; and (f) HVR-L3 comprising the amino acid sequence of SEQ ID NO: 133.

In one aspect, the present invention provides an antibody comprising at least one, at least two, or all three VH HVR sequences selected from (a) HVR-H1 comprising the amino acid sequence of SEQ ID NO: 107; (b) HVR-H2 comprising the amino acid sequence of SEQ ID NO: 108; and (c) HVR-H3 comprising the amino acid sequence of SEQ ID NO: 102. In one embodiment, the antibody comprises (a) HVR-H1 comprising the amino acid sequence of SEQ ID NO: 107; (b) HVR-H2 comprising the amino acid sequence of SEQ ID NO: 108; and (c) HVR-H3 comprising the amino acid sequence of SEQ ID NO: 102.

In another aspect, the present invention provides an antibody comprising at least one, at least two, or all three VL HVR sequences selected from (a) HVR-L1 comprising the amino acid sequence of SEQ ID NO: 121; (b) HVR-L2 comprising the amino acid sequence of SEQ ID NO: 123; and (c) HVR-L3 comprising the amino acid sequence of SEQ ID NO: 153. In one embodiment, the antibody comprises (a) HVR-L1 comprising the amino acid sequence of SEQ ID NO: 121; (b) HVR-L2 comprising the amino acid sequence of SEQ ID NO: 123; and (c) HVR-L3 comprising the amino acid sequence of SEQ ID NO: 153.

In another aspect, an antibody of the present invention comprises (a) a VH domain comprising at least one, at least two, or all three VH HVR sequences selected from (i) HVR-H1 comprising the amino acid sequence of SEQ ID NO: 107, (ii) HVR-H2 comprising the amino acid sequence of SEQ ID NO: 108, and (iii) HVR-H3 comprising an amino acid sequence of SEQ ID NO: 102; and (b) a VL domain comprising at least one, at least two, or all three VL HVR sequences selected from (i) HVR-L1 comprising the amino acid sequence of SEQ ID NO: 121, (ii) HVR-L2 comprising the amino acid sequence of SEQ ID NO: 123, and (iii) HVR-L3 comprising the amino acid sequence of SEQ ID NO: 153.

In another aspect, the present invention provides an antibody comprising (a) HVR-H1 comprising the amino acid sequence of SEQ ID NO: 107; (b) HVR-H2 comprising the amino acid sequence of SEQ ID NO: 108; (c) HVR-H3 comprising the amino acid sequence of SEQ ID NO: 102; (d) HVR-L1 comprising the amino acid sequence of SEQ ID NO: 121; (e) HVR-L2 comprising the amino acid sequence of SEQ ID NO: 123; and (f) HVR-L3 comprising the amino acid sequence of SEQ ID NO: 153.

In one aspect, the present invention provides an antibody comprising at least one, at least two, or all three VH HVR sequences selected from (a) HVR-H1 comprising the amino acid sequence of SEQ ID NO: 107; (b) HVR-H2 comprising the amino acid sequence of SEQ ID NO: 110; and (c) HVR-H3 comprising the amino acid sequence of SEQ ID NO: 102. In one embodiment, the antibody comprises (a) HVR-H1 comprising the amino acid sequence of SEQ ID NO: 107; (b) HVR-H2 comprising the amino acid sequence of SEQ ID NO: 110; and (c) HVR-H3 comprising the amino acid sequence of SEQ ID NO: 102.

In another aspect, the present invention provides an antibody comprising at least one, at least two, or all three VL HVR sequences selected from (a) HVR-L1 comprising the amino acid sequence of SEQ ID NO: 122; (b) HVR-L2 comprising the amino acid sequence of SEQ ID NO: 117; and (c) HVR-L3 comprising the amino acid sequence of SEQ ID NO: 133. In one embodiment, the antibody comprises (a) HVR-L1 comprising the amino acid sequence of SEQ ID NO: 122; (b) HVR-L2 comprising the amino acid sequence of SEQ ID NO: 117; and (c) HVR-L3 comprising the amino acid sequence of SEQ ID NO: 133.

In another aspect, an antibody of the present invention comprises (a) a VH domain comprising at least one, at least two, or all three VH HVR sequences selected from (i) HVR-H1 comprising the amino acid sequence of SEQ ID NO: 107, (ii) HVR-H2 comprising the amino acid sequence of SEQ ID NO: 110, and (iii) HVR-H3 comprising an amino acid sequence of SEQ ID NO: 102; and (b) a VL domain comprising at least one, at least two, or all three VL HVR sequences selected from (i) HVR-L1 comprising the amino acid sequence of SEQ ID NO: 122, (ii) HVR-L2 comprising the amino acid sequence of SEQ ID NO: 117, and (iii) HVR-L3 comprising the amino acid sequence of SEQ ID NO: 133.

In another aspect, the present invention provides an antibody comprising (a) HVR-H1 comprising the amino acid sequence of SEQ ID NO: 107; (b) HVR-H2 comprising the amino acid sequence of SEQ ID NO: 110; (c) HVR-H3 comprising the amino acid sequence of SEQ ID NO: 102; (d) HVR-L1 comprising the amino acid sequence of SEQ ID NO: 122; (e) HVR-L2 comprising the amino acid sequence of SEQ ID NO: 117; and (f) HVR-L3 comprising the amino acid sequence of SEQ ID NO: 133.

In one aspect, the present invention provides an antibody comprising at least one, at least two, or all three VH HVR sequences selected from (a) HVR-H1 comprising the amino acid sequence of SEQ ID NO: 107; (b) HVR-H2 comprising the amino acid sequence of SEQ ID NO: 112; and (c) HVR-H3 comprising the amino acid sequence of SEQ ID NO: 102. In one embodiment, the antibody comprises (a) HVR-H1 comprising the amino acid sequence of SEQ ID NO: 107; (b) HVR-H2 comprising the amino acid sequence of SEQ ID NO: 112; and (c) HVR-H3 comprising the amino acid sequence of SEQ ID NO: 102.

In another aspect, the present invention provides an antibody comprising at least one, at least two, or all three VL HVR sequences selected from (a) HVR-L1 comprising the amino acid sequence of SEQ ID NO: 128; (b) HVR-L2 comprising the amino acid sequence of SEQ ID NO: 117; and (c) HVR-L3 comprising the amino acid sequence of SEQ ID NO: 133. In one embodiment, the antibody comprises (a) HVR-L1 comprising the amino acid sequence of SEQ ID NO: 128; (b) HVR-L2 comprising the amino acid sequence of SEQ ID NO: 117; and (c) HVR-L3 comprising the amino acid sequence of SEQ ID NO: 133.

In another aspect, an antibody of the present invention comprises (a) a VH domain comprising at least one, at least two, or all three VH HVR sequences selected from (i) HVR-H1 comprising the amino acid sequence of SEQ ID NO: 107, (ii) HVR-H2 comprising the amino acid sequence of SEQ ID NO: 112, and (iii) HVR-H3 comprising an amino acid sequence of SEQ ID NO: 102; and (b) a VL domain comprising at least one, at least two, or all three VL HVR sequences selected from (i) HVR-L1 comprising the amino acid sequence of SEQ ID NO: 128, (ii) HVR-L2 comprising the amino acid sequence of SEQ ID NO: 117, and (iii) HVR-L3 comprising the amino acid sequence of SEQ ID NO: 133.

In another aspect, the present invention provides an antibody comprising (a) HVR-H1 comprising the amino acid sequence of SEQ ID NO: 107; (b) HVR-H2 comprising the amino acid sequence of SEQ ID NO: 112; (c) HVR-H3 comprising the amino acid sequence of SEQ ID NO: 102; (d) HVR-L1 comprising the amino acid sequence of SEQ ID NO: 128; (e) HVR-L2 comprising the amino acid sequence of SEQ ID NO: 117; and (f) HVR-L3 comprising the amino acid sequence of SEQ ID NO: 133.

In one aspect, the present invention provides an antibody comprising at least one, at least two, or all three VH HVR sequences selected from (a) HVR-H1 comprising the amino acid sequence of SEQ ID NO: 107; (b) HVR-H2 comprising the amino acid sequence of SEQ ID NO: 111; and (c) HVR-H3 comprising the amino acid sequence of SEQ ID NO: 152. In one embodiment, the antibody comprises (a) HVR-H1 comprising the amino acid sequence of SEQ ID NO: 107; (b) HVR-H2 comprising the amino acid sequence of SEQ ID NO: 111; and (c) HVR-H3 comprising the amino acid sequence of SEQ ID NO: 152.

In another aspect, the present invention provides an antibody comprising at least one, at least two, or all three VL HVR sequences selected from (a) HVR-L1 comprising the amino acid sequence of SEQ ID NO: 128; (b) HVR-L2 comprising the amino acid sequence of SEQ ID NO: 117; and (c) HVR-L3 comprising the amino acid sequence of SEQ ID NO: 133. In one embodiment, the antibody comprises (a) HVR-L1 comprising the amino acid sequence of SEQ ID NO: 128; (b) HVR-L2 comprising the amino acid sequence of SEQ ID NO: 117; and (c) HVR-L3 comprising the amino acid sequence of SEQ ID NO: 133.

In another aspect, an antibody of the present invention comprises (a) a VH domain comprising at least one, at least two, or all three VH HVR sequences selected from (i) HVR-H1 comprising the amino acid sequence of SEQ ID NO: 107, (ii) HVR-H2 comprising the amino acid sequence of SEQ ID NO: 111, and (iii) HVR-H3 comprising an amino acid sequence of SEQ ID NO: 152; and (b) a VL domain comprising at least one, at least two, or all three VL HVR sequences selected from (i) HVR-L1 comprising the amino acid sequence of SEQ ID NO: 128, (ii) HVR-L2 comprising the amino acid sequence of SEQ ID NO: 117, and (iii) HVR-L3 comprising the amino acid sequence of SEQ ID NO: 133.

In another aspect, the present invention provides an antibody comprising (a) HVR-H1 comprising the amino acid sequence of SEQ ID NO: 107; (b) HVR-H2 comprising the amino acid sequence of SEQ ID NO: 111; (c) HVR-H3 comprising the amino acid sequence of SEQ ID NO: 152; (d) HVR-L1 comprising the amino acid sequence of SEQ ID NO: 128; (e) HVR-L2 comprising the amino acid sequence of SEQ ID NO: 117; and (f) HVR-L3 comprising the amino acid sequence of SEQ ID NO: 133.

In one aspect, the present invention provides an antibody comprising at least one, at least two, or all three VH HVR sequences selected from (a) HVR-H1 comprising the amino acid sequence of SEQ ID NO: 107; (b) HVR-H2 comprising the amino acid sequence of SEQ ID NO: 112; and (c) HVR-H3 comprising the amino acid sequence of SEQ ID NO: 102. In one embodiment, the antibody comprises (a) HVR-H1 comprising the amino acid sequence of SEQ ID NO: 107; (b) HVR-H2 comprising the amino acid sequence of SEQ ID NO: 112; and (c) HVR-H3 comprising the amino acid sequence of SEQ ID NO: 102.

In another aspect, the present invention provides an antibody comprising at least one, at least two, or all three VL HVR sequences selected from (a) HVR-L1 comprising the amino acid sequence of SEQ ID NO: 129; (b) HVR-L2 comprising the amino acid sequence of SEQ ID NO: 117; and (c) HVR-L3 comprising the amino acid sequence of SEQ ID NO: 133. In one embodiment, the antibody comprises (a) HVR-L1 comprising the amino acid sequence of SEQ ID NO: 129; (b) HVR-L2 comprising the amino acid sequence of SEQ ID NO: 117; and (c) HVR-L3 comprising the amino acid sequence of SEQ ID NO: 133.

In another aspect, an antibody of the present invention comprises (a) a VH domain comprising at least one, at least two, or all three VH HVR sequences selected from (i) HVR-H1 comprising the amino acid sequence of SEQ ID NO: 107, (ii) HVR-H2 comprising the amino acid sequence of SEQ ID NO: 112, and (iii) HVR-H3 comprising an amino acid sequence of SEQ ID NO: 102; and (b) a VL domain comprising at least one, at least two, or all three VL HVR sequences selected from (i) HVR-L1 comprising the amino acid sequence of SEQ ID NO: 129, (ii) HVR-L2 comprising the amino acid sequence of SEQ ID NO: 117, and (iii) HVR-L3 comprising the amino acid sequence of SEQ ID NO: 133.

In another aspect, the present invention provides an antibody comprising (a) HVR-H1 comprising the amino acid sequence of SEQ ID NO: 107; (b) HVR-H2 comprising the amino acid sequence of SEQ ID NO: 112; (c) HVR-H3 comprising the amino acid sequence of SEQ ID NO: 102; (d) HVR-L1 comprising the amino acid sequence of SEQ ID NO: 129; (e) HVR-L2 comprising the amino acid sequence of SEQ ID NO: 117; and (f) HVR-L3 comprising the amino acid sequence of SEQ ID NO: 133.

In one aspect, the present invention provides an antibody comprising at least one, at least two, or all three VH HVR sequences selected from (a) HVR-H1 comprising the amino acid sequence of SEQ ID NO: 107; (b) HVR-H2 comprising the amino acid sequence of SEQ ID NO: 111; and (c) HVR-H3 comprising the amino acid sequence of SEQ ID NO: 152. In one embodiment, the antibody comprises (a) HVR-H1 comprising the amino acid sequence of SEQ ID NO: 107; (b) HVR-H2 comprising the amino acid sequence of SEQ ID NO: 111; and (c) HVR-H3 comprising the amino acid sequence of SEQ ID NO: 152.

In another aspect, the present invention provides an antibody comprising at least one, at least two, or all three VL HVR sequences selected from (a) HVR-L1 comprising the amino acid sequence of SEQ ID NO: 129; (b) HVR-L2 comprising the amino acid sequence of SEQ ID NO: 117; and (c) HVR-L3 comprising the amino acid sequence of SEQ ID NO: 133. In one embodiment, the antibody comprises (a) HVR-L1 comprising the amino acid sequence of SEQ ID NO: 129; (b) HVR-L2 comprising the amino acid sequence of SEQ ID NO: 117; and (c) HVR-L3 comprising the amino acid sequence of SEQ ID NO: 133.

In another aspect, an antibody of the present invention comprises (a) a VH domain comprising at least one, at least two, or all three VH HVR sequences selected from (i) HVR-H1 comprising the amino acid sequence of SEQ ID NO: 107, (ii) HVR-H2 comprising the amino acid sequence of SEQ ID NO: 111, and (iii) HVR-H3 comprising an amino acid sequence of SEQ ID NO: 152; and (b) a VL domain comprising at least one, at least two, or all three VL HVR sequences selected from (i) HVR-L1 comprising the amino acid sequence of SEQ ID NO: 129, (ii) HVR-L2 comprising the amino acid sequence of SEQ ID NO: 117, and (iii) HVR-L3 comprising the amino acid sequence of SEQ ID NO: 133.

In another aspect, the present invention provides an antibody comprising (a) HVR-H1 comprising the amino acid sequence of SEQ ID NO: 107; (b) HVR-H2 comprising the amino acid sequence of SEQ ID NO: 111; (c) HVR-H3 comprising the amino acid sequence of SEQ ID NO: 152; (d) HVR-L1 comprising the amino acid sequence of SEQ ID NO: 129; (e) HVR-L2 comprising the amino acid sequence of SEQ ID NO: 117; and (f) HVR-L3 comprising the amino acid sequence of SEQ ID NO: 133.

In one aspect, the present invention provides an antibody comprising at least one, at least two, or all three VH HVR sequences selected from (a) HVR-H1 comprising the amino acid sequence of SEQ ID NO: 107; (b) HVR-H2 comprising the amino acid sequence of SEQ ID NO: 109; and (c) HVR-H3 comprising the amino acid sequence of SEQ ID NO: 102. In one embodiment, the antibody comprises (a) HVR-H1 comprising the amino acid sequence of SEQ ID NO: 107; (b) HVR-H2 comprising the amino acid sequence of SEQ ID NO: 109; and (c) HVR-H3 comprising the amino acid sequence of SEQ ID NO: 102.

In another aspect, the present invention provides an antibody comprising at least one, at least two, or all three VL HVR sequences selected from (a) HVR-L1 comprising the amino acid sequence of SEQ ID NO: 130; (b) HVR-L2 comprising the amino acid sequence of SEQ ID NO: 117; and (c) HVR-L3 comprising the amino acid sequence of SEQ ID NO: 133. In one embodiment, the antibody comprises (a) HVR-L1 comprising the amino acid sequence of SEQ ID NO: 130; (b) HVR-L2 comprising the amino acid sequence of SEQ ID NO: 117; and (c) HVR-L3 comprising the amino acid sequence of SEQ ID NO: 133.

In another aspect, an antibody of the present invention comprises (a) a VH domain comprising at least one, at least two, or all three VH HVR sequences selected from (i) HVR-H1 comprising the amino acid sequence of SEQ ID NO: 107, (ii) HVR-H2 comprising the amino acid sequence of SEQ ID NO: 109, and (iii) HVR-H3 comprising an amino acid sequence of SEQ ID NO: 102; and (b) a VL domain comprising at least one, at least two, or all three VL HVR sequences selected from (i) HVR-L1 comprising the amino acid sequence of SEQ ID NO: 130, (ii) HVR-L2 comprising the amino acid sequence of SEQ ID NO: 117, and (iii) HVR-L3 comprising the amino acid sequence of SEQ ID NO: 133.

In another aspect, the present invention provides an antibody comprising (a) HVR-H1 comprising the amino acid sequence of SEQ ID NO: 107; (b) HVR-H2 comprising the amino acid sequence of SEQ ID NO: 109; (c) HVR-H3 comprising the amino acid sequence of SEQ ID NO: 102; (d) HVR-L1 comprising the amino acid sequence of SEQ ID NO: 130; (e) HVR-L2 comprising the amino acid sequence of SEQ ID NO: 117; and (f) HVR-L3 comprising the amino acid sequence of SEQ ID NO: 133.

In certain embodiments, any one or more amino acids of an anti-CTLA-4 antibody as provided above are substituted at the following HVR positions:
  in HVR-H1 (SEQ ID NO: 223): position 2
  in HVR-H2 (SEQ ID NO: 224): positions 4, 5, 7, 13, and 16
  in HVR-H3 (SEQ ID NO: 225): position 3
  in HVR-L1 (SEQ ID NO: 226): positions 1, 3, 6, 11, 12, and 14
  in HVR-L2 (SEQ ID NO: 227): positions 1, 3, 4, and 7
  in HVR-L3 (SEQ ID NO: 228): positions 1 and 10

In certain embodiments, the substitutions are conservative substitutions, as provided herein. In certain embodiments, any one or more of the following substitutions may be made in any combination:
  in HVR-H1 (SEQ ID NO: 100): H2A, R, or K
  in HVR-H2 (SEQ ID NO: 101): S4T; R5Q; G7H; D13E or R; K16R
  in HVR-H3 (SEQ ID NO: 102): K3A
  in HVR-L1 (SEQ ID NO: 113): T1D, Q, or E; T3P; D6G; N11T; Y12W; S14H
  in HVR-L2 (SEQ ID NO: 114): E1F or Y; S3I; K4S; S7E or K
  in HVR-L3 (SEQ ID NO: 115): S1Q; M10T All possible combinations of the above substitutions are encompassed by the consensus sequences of SEQ ID NOs: 223, 224, 225, 226, 227, and 228 for HVR-H1, HVR-H2, HVR-H3, HVR-L1, HVR-L2, and HVR-L3, respectively.

In any of the above embodiments, an anti-CTLA-4 antibody is humanized. In one embodiment, an anti-CTLA-4 antibody comprises HVRs as in any of the above embodiments, and further comprises an acceptor human framework, e.g., a human immunoglobulin framework or a human consensus framework. In another embodiment, an anti-CTLA-4 antibody comprises HVRs as in any of the above embodiments, and further comprises a VH or VL comprising an FR sequence. In a further embodiment, an anti-CTLA-4 antibody comprises a heavy chain and/or light chain variable domain FR sequence(s) as follows: for a heavy chain variable domain, FR1 comprises any one of the amino acid sequences of SEQ ID NOs: 229 to 232, FR2 comprises the amino acid sequence of SEQ ID NO: 233, FR3 comprises the amino acid sequence of SEQ ID NO: 234, and FR4 comprises the amino acid sequence of SEQ ID NO: 235; and for a light chain variable domain, FR1 comprises any one of the amino acid sequences of SEQ ID NOs: 236 to 238, FR2 comprises any one of the amino acid sequences of SEQ ID NOs: 240 to 241, FR3 comprises any one of the amino acid sequences of SEQ ID NOs: 242 to 244, and FR4 comprises any one of the amino acid sequences of SEQ ID NOs: 245 to 246.

In another aspect, an anti-CTLA-4 antibody comprises a heavy chain variable domain (VH) sequence having at least 90%, 91%, 92%, 93%, 94%, 95%, 96%, 97%, 98%, 99%, or 100% sequence identity to the amino acid sequence of SEQ ID NO: 10. In certain embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-CTLA-4 antibody comprising that sequence retains the ability to bind to CTLA-4. In certain embodiments, a total of 1 to 10, to 11, to 12, to 13, to 14, or to 15 amino acids have been substituted, inserted and/or deleted in SEQ ID NO: 10. In certain embodiments, substitutions, insertions, or deletions occur in regions outside the HVRs (i.e., in the FRs). Optionally, the anti-CTLA-4 antibody comprises the VH sequence in SEQ ID NO: 10, including post-translational modifications of that sequence. In a particular embodiment, the VH comprises one, two or three HVRs selected from: (a) HVR-H1 comprising the amino acid sequence of SEQ ID NO: 100, (b) HVR-H2 comprising the amino acid sequence of SEQ ID NO: 101, and (c) HVR-H3 comprising the amino acid sequence of SEQ ID NO: 102. Post-translational modifications include but are not limited to a modification of glutamine or glutamate in N-terminus of heavy chain or light chain to pyroglutamic acid by pyroglutamylation.

In another aspect, an anti-CTLA-4 antibody is provided, wherein the antibody comprises a light chain variable domain (VL) having at least 90%, 91%, 92%, 93%, 94%, 95%, 96%, 97%, 98%, 99%, or 100% sequence identity to the amino acid sequence of SEQ ID NO: 11. In certain embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-CTLA-4 antibody comprising that sequence retains the ability to bind to CTLA-4. In certain embodiments, a total of 1 to 10, to 11, to 12, to 13, to 14, or to 15 amino acids have been substituted, inserted and/or deleted in SEQ ID NO: 11. In certain embodiments, the substitutions, insertions, or deletions occur in regions outside the HVRs (i.e., in the FRs). Optionally, the anti-CTLA-4 antibody comprises the VL sequence in SEQ ID NO: 11, including post-translational modifications of that sequence. In a particular embodiment, the VL comprises one, two or three HVRs selected from (a) HVR-L1 comprising the amino acid sequence of SEQ ID NO: 113; (b) HVR-L2 comprising the amino acid sequence of SEQ ID NO: 114; and (c) HVR-L3 comprising the amino acid sequence of SEQ ID NO: 115. Post-translational modifications include but are not limited to a modification of glutamine or glutamate in N-terminus of heavy chain or light chain to pyroglutamic acid by pyroglutamylation.

In another aspect, an anti-CTLA-4 antibody is provided, wherein the antibody comprises a light chain variable domain (VL) having at least 90%, 91%, 92%, 93%, 94%, 95%, 96%, 97%, 98%, 99%, or 100% sequence identity to the amino acid sequence of SEQ ID NO: 149. In certain embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-CTLA-4 antibody comprising that sequence retains the ability to bind to CTLA-4. In certain embodiments, a total of 1 to 10, to 11, to 12, to 13, to 14, or to 15 amino acids have been substituted, inserted and/or deleted in SEQ ID NO: 149. In certain embodiments, the substitutions, insertions, or deletions occur in regions outside the HVRs (i.e., in the FRs). Optionally, the anti-CTLA-1 antibody comprises the VL sequence in SEQ ID NO: 149, including post-translational modifications of that sequence. In a particular embodiment, the VL comprises one, two or three HVRs selected from (a) HVR-L1 comprising the amino acid sequence of SEQ ID NO: 130; (b) HVR-L2 comprising the amino acid sequence of SEQ ID NO: 117; and (c) HVR-L3 comprising the amino acid sequence of SEQ ID NO: 133. Post-translational modifications include but are not limited to a modification of glutamine or glutamate in N-terminus of heavy chain or light chain to pyroglutamic acid by pyroglutamylation.

In another aspect, an anti-CTLA-4 antibody is provided, wherein the antibody comprises a VH as in any of the embodiments provided above, and a VL as in any of the embodiments provided above. In one embodiment, the antibody comprises the VH and VL sequences in SEQ ID NO: 10 and SEQ ID NO: 11, respectively, including post-translational modifications of those sequences. In one embodiment, the antibody comprises the VH and VL sequences in SEQ ID NO: 98 and SEQ ID NO: 99, respectively, including post-translational modifications of those sequences. In one embodiment, the antibody comprises the VH and VL sequences in SEQ ID NO: 83 and SEQ ID NO: 88, respectively, including post-translational modifications of those sequences. In one embodiment, the antibody comprises the VH and VL sequences in SEQ ID NO: 83 and SEQ ID NO: 89, respectively, including post-translational modifications of those sequences. In one embodiment, the antibody comprises the VH and VL sequences in SEQ ID NO: 83 and SEQ ID NO: 90, respectively, including post-translational modifications of those sequences. In one embodiment, the antibody comprises the VH and VL sequences in SEQ ID NO: 83 and SEQ ID NO: 91, respectively, including post-translational modifications of those sequences. In one embodiment, the antibody comprises the VH and VL sequences in SEQ ID NO: 83 and SEQ ID NO: 92, respectively, including post-translational modifications of those sequences. In one embodiment, the antibody comprises the VH and VL sequences in SEQ ID NO: 83 and SEQ ID NO: 93, respectively, including post-translational modifications of those sequences. In one embodiment, the antibody comprises the VH and VL sequences in SEQ ID NO: 83 and SEQ ID NO: 94, respectively, including post-translational modifications of those sequences. In one embodiment, the antibody comprises the VH and VL sequences in SEQ ID NO: 83 and SEQ ID NO: 97, respectively, including post-translational modifications of those sequences. In one embodiment, the antibody comprises the VH and VL sequences in SEQ ID NO: 83 and SEQ ID NO: 95, respectively, including post-translational modifications of those sequences. In one embodiment, the antibody comprises the VH and VL sequences in SEQ ID NO: 84 and SEQ ID NO: 97, respectively, including post-translational modifications of those sequences. In one embodiment, the antibody comprises the VH and VL sequences in SEQ ID NO: 85 and SEQ ID NO: 97, respectively, including post-translational modifications of those sequences. In one embodiment, the antibody comprises the VH and VL sequences in SEQ ID NO: 86 and SEQ ID NO: 97, respectively, including post-translational modifications of those sequences. In one embodiment, the antibody comprises the VH and VL sequences in SEQ ID NO: 86 and SEQ ID NO: 134, respectively, including post-translational modifications of those sequences. In one embodiment, the antibody comprises the VH and VL sequences in SEQ ID NO: 136 and SEQ ID NO: 97, respectively, including post-translational modifications of those sequences. In one embodiment, the antibody comprises the VH and VL sequences in SEQ ID NO: 135 and SEQ ID NO: 97, respectively, including post-translational modifications of those sequences. In one embodiment, the antibody comprises the VH and VL sequences in SEQ ID NO: 136 and SEQ ID NO: 95, respectively, including post-translational modifications of those sequences. In one embodiment, the antibody comprises the VH and VL sequences in SEQ ID NO: 137 and SEQ ID NO: 97, respectively, including post-translational modifications of those sequences. In one embodiment, the antibody comprises the VH and VL sequences in SEQ ID NO: 138 and SEQ ID NO: 97, respectively, including post-translational modifications of those sequences. In one embodiment, the antibody comprises the VH and VL sequences in SEQ ID NO: 138 and SEQ ID NO: 144, respectively, including post-translational modifications of those sequences. In one embodiment, the antibody comprises the VH and VL sequences in SEQ ID NO: 138 and SEQ ID NO: 145, respectively, including post-translational modifications of those sequences. In one embodiment, the antibody comprises the VH and VL sequences in SEQ ID NO: 138 and SEQ ID NO: 146, respectively, including post-translational modifications of those sequences. In one embodiment, the antibody comprises the VH and VL sequences in SEQ ID NO: 139 and SEQ ID NO: 146, respectively, including post-translational modifications of those sequences. In one embodiment, the antibody comprises the VH and VL sequences in SEQ ID NO: 140 and SEQ ID NO: 146, respectively, including post-translational modifications of those sequences. In one embodiment, the antibody comprises the VH and VL sequences in SEQ ID NO: 141 and SEQ ID NO: 146, respectively, including post-translational modifications of those sequences. In one embodiment, the antibody comprises the VH and VL sequences in SEQ ID NO: 140 and SEQ ID NO: 147, respectively, including post-translational modifications of those sequences. In one embodiment, the antibody comprises the VH and VL sequences in SEQ ID NO: 141 and SEQ ID NO: 147, respectively, including post-translational modifications of those sequences. In one embodiment, the antibody comprises the VH and VL sequences in SEQ ID NO: 140 and SEQ ID NO: 148, respectively, including post-translational modifications of those sequences. In one embodiment, the antibody comprises the VH and VL sequences in SEQ ID NO: 141 and SEQ ID NO: 148, respectively, including post-translational modifications of those sequences. In one embodiment, the antibody comprises the VH and VL sequences in SEQ ID NO: 136 and SEQ ID NO: 149, respectively, including post-translational modifications of those sequences. In a further aspect, a heteromeric anti-CTLA-4 antibody is provided, wherein the antibody comprises at least two different variable regions selected from the variable regions comprising VH and VL sequences provided above. In one embodiment, the antibody comprises the VH and VL sequences in SEQ ID NO: 140 and SEQ ID NO: 146, respectively, and the VH and VL sequences in SEQ ID NO: 141 and SEQ ID NO: 146, respectively, including post-translational modifications of those sequences. In one embodiment, the antibody comprises the VH and VL sequences in SEQ ID NO: 140 and SEQ ID NO: 147, respectively, and the VH and VL sequences in SEQ ID NO: 141 and SEQ ID NO: 147, respectively, including post-translational modifications of that sequences. Post-translational modifications include but are not limited to a modification of glutamine or glutamate in N-terminus of heavy chain or light chain to pyroglutamic acid by pyroglutamylation.

When the amino acid at the N-terminus of the heavy chain or the light chain of an anti-CTLA-4 antibody provided herein is glutamine, this amino acid may be substituted with glutamate. When the amino acid at the N-terminus of the heavy chain or the light chain of an anti-CTLA-4 antibody provided herein is glutamate, this amino acid may be substituted with glutamine.

In a further aspect, the present invention provides an antibody that binds to the same epitope as an anti-CTLA-4 antibody provided herein. For example, in certain embodiments, an antibody is provided that binds to the same epitope as any one of the antibodies listed in Table 20, Table 25, Table 30, and Table 35. In certain embodiments, an antibody is provided that binds to an epitope within a fragment of CTLA-4 comprising at least one amino acid selected from the group consisting of the amino acids at position 3 (Met), position 33 (Glu), position 35 (Arg), position 53 (Thr), position 97 (Glu), position 99 (Met), position 100 (Tyr), position 101 (Pro), position 102 (Pro), position 103 (Pro), position 104 (Tyr), position 105 (Tyr), and position 106 (Leu) of SEQ ID NO: 28. In certain embodiments, an antibody is provided that binds to an epitope within a fragment of CTLA-4 consisting of the amino acids from position 97 (Glu) to position 106 (Leu) of SEQ ID NO: 28. In certain embodiments, an antibody is provided that binds to an epitope within a fragment of CTLA-4 consisting of the amino acids from position 99 (Met) to position 106 (Leu) of SEQ ID NO: 28.

In a further aspect of the present invention, an anti-CTLA-4 antibody according to any of the above embodiments is a monoclonal antibody, including a chimeric, humanized or human antibody. In one embodiment, an anti-CTLA-4 antibody is an antibody fragment, e.g., a Fv, Fab, Fab', scFv, diabody, or F(ab')$_2$ fragment. In another embodiment, the antibody is a full length antibody, e.g., an intact IgG1 antibody, an intact IgG4 antibody, or other antibody class or isotype as defined herein.

In a further aspect, the anti-CTLA-4 antibodies of the present invention comprise an Fc region. In a further aspect, the anti-CTLA-4 antibodies of the present invention comprise constant regions. The constant regions may be heavy chain constant regions (including Fc regions), light chain constant regions, or both. In some embodiments, the Fc region is that of a native sequence. Exemplary heavy chain constant regions derived from native antibodies can include, for example, heavy chain constant regions such as human IgG1 (SEQ ID NO: 249), human IgG2 (SEQ ID NO: 250), human IgG3 (SEQ ID NO: 251), and human IgG4 (SEQ ID NO: 252). Furthermore, other exemplary heavy chain constant regions can include heavy chain constant regions of SEQ ID NOs: 82, 158, and 334. Exemplary light chain constant regions derived from native antibodies can include, for example, light chain constant regions such as human κ chain (SEQ ID NOs: 33, 63, and 159) and human λ chain (SEQ ID NOs: 53 and 87).

In another embodiment, the Fc region is a variant Fc region produced by adding amino acid alterations to the Fc region of a native sequence. In certain embodiments, the variant Fc region has enhanced binding activity to at least one Fcγ receptor selected from the group consisting of FcγRIa, FcγRIIa, FcγRIIb, and FcγRIIIa, compared to the Fc region of a native sequence. In further embodiments, the variant Fc region has enhanced binding activity to FcγRIIa and FcγRIIIa compared to the Fc region of a native sequence. Examples of heavy chain constant regions comprising such a variant Fc region include, for example, the heavy chain constant regions listed in Tables 42 to 46, the heavy chain constant regions of SEQ ID NOs: 31, 32, 41 to 46, 65, 66, 81, 207, 239, 253 to 271, 276, 277, 278, 308, 309, 311 to 333, and 358 to 367, and the heavy chain constant regions of SEQ ID NOs: 31, 32, 41 to 46, 65, 66, 81, 207, 239, 253 to 271, 276, 277, 278, 308, 309, 311 to 333, 376 to 381, 383, and 384.

The Fc region of a native sequence is usually composed as a homodimer consisting of two identical polypeptide chains. In certain embodiments, the variant Fc region may be a homodimer composed of polypeptide chains with the same sequence, or a heterodimer composed of polypeptide chains with different sequences from each other. Similarly, the heavy chain constant regions comprising the Fc region may be a homodimer composed of polypeptide chains with the same sequence, or a heterodimer composed of polypeptide chains with different sequences from each other. Examples of heteromeric heavy chain constant regions include, for example, the heavy chain constant regions comprising the polypeptide chains of SEQ ID NOs: 31 and 32; the heavy chain constant regions comprising the polypeptide chains of SEQ ID NOs: 43 and 44; the heavy chain constant regions comprising the polypeptide chains of SEQ ID NOs: 45 and 46; the heavy chain constant regions comprising the polypeptide chains of SEQ ID NOs: 254 and 256; the heavy chain constant regions comprising the polypeptide chains of SEQ ID NOs: 257 and 258; the heavy chain constant regions comprising the polypeptide chains of SEQ ID NOs: 259 and 260; the heavy chain constant regions comprising the polypeptide chains of SEQ ID NOs: 261 and 263; the heavy chain constant regions comprising the polypeptide chains of SEQ ID NOs: 262 and 264; the heavy chain constant regions comprising the polypeptide chains of SEQ ID NOs: 265 and 267; the heavy chain constant regions comprising the polypeptide chains of SEQ ID NOs: 266 and 268; the heavy chain constant regions comprising the polypeptide chains of SEQ ID NOs: 269 and 270; the heavy chain constant regions comprising the polypeptide chains of SEQ ID NOs: 271 and 81; the heavy chain constant regions comprising the polypeptide chains of SEQ ID NOs: 65 and 66; the heavy chain constant regions comprising the polypeptide chains of SEQ ID NOs: 239 and 207; the heavy chain constant regions comprising the polypeptide chains of SEQ ID NOs: 259 and 276; the heavy chain constant regions comprising the polypeptide chains of SEQ ID NOs: 65 and 278; the heavy chain constant regions comprising the polypeptide chains of SEQ ID NOs: 308 and 309; the heavy chain constant regions comprising the polypeptide chains of SEQ ID NOs: 311 and 312; the heavy chain constant regions comprising the polypeptide chains of SEQ ID NOs: 313 and 314; the heavy chain constant regions comprising the polypeptide chains of SEQ ID NOs: 315 and 316; the heavy chain constant regions comprising the polypeptide chains of SEQ ID NOs: 317 and 318; the heavy chain constant regions comprising the polypeptide chains of SEQ ID NOs: 319 and 320; the heavy chain constant region comprising 321 and 322; the heavy chain constant regions comprising the polypeptide chains of SEQ ID NOs: 323 and 324; the heavy chain constant regions comprising the polypeptide chains of SEQ ID NOs: 325 and 326; the heavy chain constant regions comprising the polypeptide chains of SEQ ID NOs: 327 and 328; the heavy chain constant regions comprising the polypeptide chains of SEQ ID NOs: 330 and 331; the heavy chain constant regions comprising the polypeptide chains of SEQ ID NOs: 332 and 333; the heavy chain constant regions comprising the polypeptide chains of SEQ ID NOs: 358 and 359; the heavy chain constant regions comprising the polypeptide chains of SEQ ID NOs: 360 and 361; the heavy chain constant regions comprising the polypeptide chains of SEQ ID NOs: 362 and 363; the heavy chain constant regions comprising the polypeptide chains of SEQ ID NOs: 364 and 366; and the heavy chain constant regions comprising the polypeptide chains of SEQ ID NOs: 365 and 367; the heavy chain constant regions comprising the polypeptide chains of SEQ ID NOs: 376 and 377; the heavy chain constant regions comprising the polypeptide chains of SEQ ID NOs: 378 and 380; the heavy chain constant regions comprising the polypeptide chains of SEQ ID NOs: 379 and 381; and the heavy chain constant regions comprising the polypeptide chains of SEQ ID NOs: 383 and 384.

In a further aspect, an anti-CTLA-4 antibody according to any of the above embodiments may incorporate any of the features, singly or in combination, as described in Sections 1-7 below:

1. Binding Activity of Antibody

In certain embodiments, binding activity of an antibody provided herein is a dissociation constant (KD) of 10 µM or less, 1 µM or less, 100 nM or less, 10 nM or less, 1 nM or less, 0.1 nM or less, 0.01 nM or less, or 0.001 nM or less (e.g., $10^{-8}$ M or less, e.g., from $10^{-8}$ M to $10^{-13}$ M, e.g., from $10^{-9}$ M to $10^{-13}$ M).

In one embodiment, binding activity of an antibody is measured by a radiolabeled antigen binding assay (RIA). In one embodiment, a RIA is performed with the Fab version of an antibody of interest and its antigen. For example, solution binding affinity of Fabs for antigen is measured by equilibrating Fab with a minimal concentration of ($^{125}$I)-labeled antigen in the presence of a titration series of unlabeled antigen, then capturing bound antigen with an anti-Fab antibody-coated plate (see, e.g., Chen et al., *J. Mol. Biol.* 293: 865-881 (1999)). To establish conditions for the assay, MICROTITER (registered trademark) multi-well plates (Thermo Scientific) are coated overnight with 5 µg/ml of a capturing anti-Fab antibody (Cappel Labs) in 50 mM sodium carbonate (pH 9.6), and subsequently blocked with 2% (w/v) bovine serum albumin in PBS for two to five hours at room temperature (approximately 23° C.). In a non-adsorbent plate (Nunc #269620), 100 pM or 26 pM [$^{125}$I]-antigen are mixed with serial dilutions of a Fab of interest (e.g., consistent with assessment of the anti-VEGF antibody, Fab-12, in Presta et al., *Cancer Res.* 57: 4593-4599 (1997)). The Fab of interest is then incubated overnight; however, the incubation may continue for a longer period (e.g., about 65 hours) to ensure that equilibrium is reached. Thereafter, the mixtures are transferred to the capture plate for incubation at room temperature (e.g., for one hour). The solution is then removed and the plate is washed eight times with 0.1% polysorbate 20 (TWEEN-20 (registered trademark)) in PBS. When the plates have dried, 150 µl/well of scintillant (MICROSCINT-20™; Packard) is added, and the plates are counted on a TOPCOUNT™ gamma counter (Packard) for ten minutes. Concentrations of each Fab that give less than or equal to 20% of maximal binding are chosen for use in competitive binding assays.

In one embodiment, binding activity of an antibody is measured using a ligand capture assay using surface plasmon resonance assay as measurement principle, for example, with a BIACORE (registered trademark) T200 or a BIACORE (registered trademark) 4000 (GE Healthcare, Uppsala, Sweden). BIACORE (registered trademark) Control Software is used for device operation. In one embodiment, amine coupling kit (GE Healthcare, Uppsala, Sweden) is used according to the supplier's instruction, and sensor chip coated with carboxymethyl dextran (GE Healthcare, Uppsala, Sweden) is immobilized with a molecule for ligand capturing, for example, anti-tag antibody, anti-IgG antibody, and Protein A. A molecule for ligand capturing is diluted with 10 mM sodium acetate solution at an appropriate pH and injected at an appropriate flow rate and injection time. The binding activity assay is performed using a buffer containing 0.05% polysorbate 20 (other referred to as TWEEN (registered trademark)-20) as an assay buffer, at a flow rate of 10 to 30 µL/minute, and at an assay temperature of preferably 25° C. or 37° C. When the assay is performed by allowing a molecule for ligand capturing to capture an antibody as a ligand, serial dilution of antigen or Fc receptor prepared with assay buffer (analyte) is injected after the target amount of the antibody is captured by injecting the antibody. When the assay is performed by allowing a molecule for ligand capturing to capture antigen or Fc receptor as a ligand, serial dilution of antibody prepared with an assay buffer (analyte) is injected after the target amount of the antigen or Fc receptor is captured by injecting the antigen or Fc receptor.

In one embodiment, the assay results are analyzed using BIACORE (registered trademark) Evaluation Software. Kinetics parameters are calculated by simultaneously fitting the binding and dissociation sensorgrams using the 1:1 Binding model, and the binding rate (kon or ka), dissociation rate (koff or kd), and equilibrium dissociation constant (KD) can be calculated. When the binding activity is weak, especially when the dissociation is rapid and it is difficult to calculate the kinetics parameters, the equilibrium dissociation constant (KD) may be calculated using the Steady state model. As another parameter of the binding activity, the "binding amount of an analyte per unit amount of a ligand" may be calculated by dividing the binding amount of the analyte at a specific concentration (RU) by the amount of the ligand captured (RU).

2. Antibody Fragments

In certain embodiments, an antibody provided herein is an antibody fragment. Antibody fragments include, but are not limited to, Fab, Fab', Fab'-SH, F(ab')$_2$, Fv, and scFv fragments, and other fragments described below. For a review of certain antibody fragments, see Hudson et al., *Nat. Med.* 9:129-134 (2003). For a review of scFv fragments, see, e.g., Pluckthün, in *The Pharmacology of Monoclonal Antibodies*, vol. 113, Rosenburg and Moore eds., (Springer-Verlag, New York), pp. 269-315 (1994); see also WO 93/16185; and U.S. Pat. Nos. 5,571,894 and 5,587,458. For discussion of Fab and F(ab')$_2$ fragments comprising salvage receptor binding epitope residues and having increased in vivo half-life, see U.S. Pat. No. 5,869,046.

Diabodies are antibody fragments with two antigen-binding sites that may be bivalent or bispecific. See, for example, EP 404,097; WO 1993/01161; Hudson et al., *Nat. Med.* 9: 129-134 (2003); and Hollinger et al., *Proc. Natl. Acad. Sci. USA* 90: 6444-6448 (1993). Triabodies and tetrabodies are also described in Hudson et al., *Nat. Med.* 9: 129-134 (2003).

Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, MA; see, e.g., U.S. Pat. No. 6,248,516 B1).

Antibody fragments can be made by various techniques, including but not limited to proteolytic digestion of an intact antibody as well as production by recombinant host cells (e.g., *E. coli* or phage), as described herein.

3. Chimeric and Humanized Antibodies

In certain embodiments, an antibody provided herein is a chimeric antibody. Certain chimeric antibodies are described, e.g., in U.S. Pat. No. 4,816,567; and Morrison et al., *Proc. Natl. Acad. Sci. USA,* 81: 6851-6855 (1984)). In one example, a chimeric antibody comprises a non-human variable region (e.g., a variable region derived from a mouse, rat, hamster, rabbit, or non-human primate, such as a monkey) and a human constant region. In a further example, a chimeric antibody is a "class switched" antibody in which the class or subclass has been changed from that of the parent antibody. Chimeric antibodies include antigen-binding fragments thereof.

In certain embodiments, a chimeric antibody is a humanized antibody. Typically, a non-human antibody is humanized to reduce immunogenicity to humans, while retaining the specificity and affinity of the parental non-human antibody. Generally, a humanized antibody comprises one or more variable domains in which HVRs, e.g., CDRs, (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the HVR residues are derived), e.g., to restore or improve antibody specificity or affinity.

Humanized antibodies and methods of making them are reviewed, e.g., in Almagro and Fransson, *Front. Biosci.* 13:1619-1633 (2008), and are further described, e.g., in Riechmann et al., *Nature* 332:323-329 (1988); Queen et al., *Proc. Natl Acad. Sci. USA* 86:10029-10033 (1989); U.S. Pat. Nos. 5,821,337, 7,527,791, 6,982,321, and 7,087,409; Kashmiri et al., *Methods* 36:25-34 (2005) (describing specificity determining region (SDR) grafting); Padlan, *Mol. Immunol.* 28:489-498 (1991) (describing "resurfacing"); Dall'Acqua et al., *Methods* 36:43-60 (2005) (describing "FR shuffling"); and Osbourn et al., *Methods* 36:61-68 (2005) and Klimka et al., *Br. J. Cancer,* 83:252-260 (2000) (describing the "guided selection" approach to FR shuffling).

Human framework regions that may be used for humanization include but are not limited to: framework regions selected using the "best-fit" method (see, e.g., Sims et al., *J. Immunol.* 151:2296 (1993)); framework regions derived from the consensus sequence of human antibodies of a particular subgroup of light or heavy chain variable regions (see, e.g., Carter et al., *Proc. Natl. Acad. Sci. USA,* 89:4285 (1992); and Presta et al., *J. Immunol.,* 151:2623 (1993)); human mature (somatically mutated) framework regions or human germline framework regions (see, e.g., Almagro and Fransson, *Front. Biosci.* 13:1619-1633 (2008)); and framework regions derived from screening FR libraries (see, e.g., Baca et al., *J. Biol. Chem.* 272:10678-10684 (1997) and Rosok et al., *J. Biol. Chem.* 271:22611-22618 (1996)).

4. Human Antibodies

In certain embodiments, an antibody provided herein is a human antibody. Human antibodies can be produced using various techniques known in the art. Human antibodies are described generally in van Dijk and van de Winkel, *Curr. Opin. Pharmacol.* 5:368-374 (2001) and Lonberg, *Curr. Opin. Immunol.* 20:450-459 (2008).

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic mice, the endogenous immunoglobulin loci have generally been inactivated. For review of methods for obtaining human antibodies from transgenic animals, see Lonberg, *Nat. Biotech.* 23:1117-1125 (2005). See also, e.g., U.S. Pat. Nos. 6,075,181 and 6,150,584 describing XENO-MOUSE™ technology; U.S. Pat. No. 5,770,429 describing HuMab (registered trademark) technology; U.S. Pat. No. 7,041,870 describing K-M MOUSE (registered trademark) technology, and U.S. Patent Application Publication No. US 2007/0061900, describing VelociMouse (registered trademark) technology). Human variable regions from intact antibodies generated by such animals may be further modified, e.g., by combining with a different human constant region.

Human antibodies can also be made by hybridoma-based methods. Human myeloma and mouse-human heteromyeloma cell lines for the production of human monoclonal antibodies have been described (See, e.g., Kozbor *J. Immunol.,* 133:3001 (1984); Brodeur et al., *Monoclonal Antibody Production Techniques and Applications,* pp. 51-63 (Marcel Dekker, Inc., New York, 1987); and Boerner et al., *J. Immunol.,* 147:86 (1991)). Human antibodies generated via human B-cell hybridoma technology are also described in Li et al., *Proc. Natl. Acad. Sci. USA,* 103:3557-3562 (2006). Additional methods include those described, for example, in U.S. Pat. No. 7,189,826 (describing production of monoclonal human IgM antibodies from hybridoma cell lines) and Ni, *Xiandai Mianyixue,* 26 (4): 265-268 (2006) (describing human-human hybridomas). Human hybridoma technology (Trioma technology) is also described in Vollmers and Brandlein, *Histology and Histopathology,* 20 (3): 927-937 (2005) and Vollmers and Brandlein, *Methods and Findings in Experimental and Clinical* Pharmacology, 27 (3): 185-191 (2005).

Human antibodies may also be generated by isolating Fv clone variable domain sequences selected from human-derived phage display libraries. Such variable domain sequences may then be combined with a desired human constant domain. Techniques for selecting human antibodies from antibody libraries are described below.

5. Library-Derived Antibodies

Antibodies of the present invention may be isolated by screening combinatorial libraries for antibodies with the desired activity or activities. For example, a variety of methods are known in the art for generating phage display libraries and screening such libraries for antibodies possessing the desired binding characteristics. Such methods are reviewed, e.g., in Hoogenboom et al., in *Methods in Molecular Biology* 178:1-37 (O'Brien et al., ed., Human Press, Totowa, NJ, 2001) and further described, e.g., in the McCafferty et al., *Nature* 348:552-554; Clackson et al., *Nature* 352:624-628 (1991); Marks et al., *J. Mol. Biol.* 222:581-597 (1992); Marks and Bradbury, in *Methods in Molecular Biology* 248:161-175 (Lo, ed., Human Press, Totowa, NJ, 2003); Sidhu et al., *J. Mol. Biol.* 338 (2): 299-310 (2004); Lee et al., *J. Mol. Biol.* 340 (5): 1073-1093 (2004); *Fellouse,*

*Proc. Natl. Acad. Sci. USA* 101 (34): 12467-12472 (2004); and Lee et al., *J. Immunol. Methods* 284 (1-2): 119-132 (2004).

In certain phage display methods, repertoires of VH and VL genes are separately cloned by polymerase chain reaction (PCR) and recombined randomly in phage libraries, which can then be screened for antigen-binding phage as described in Winter et al., *Ann. Rev. Immunol.*, 12:433-455 (1994). Phage typically display antibody fragments, either as single-chain Fv (scFv) fragments or as Fab fragments. Libraries from immunized sources provide high-affinity antibodies to the immunogen without the requirement of constructing hybridomas. Alternatively, the naive repertoire can be cloned (e.g., from human) to provide a single source of antibodies to a wide range of non-self and also self antigens without any immunization as described by Griffiths et al., *EMBO J*, 12:725-734 (1993). Finally, naive libraries can also be made synthetically by cloning unrearranged V-gene segments from stem cells, and using PCR primers containing random sequence to encode the highly variable CDR3 regions and to accomplish rearrangement in vitro, as described by Hoogenboom and Winter, *J. Mol. Biol.*, 227: 381-388 (1992). Patent publications describing human antibody phage libraries include, for example: U.S. Pat. No. 5,750,373, and US Patent Publication Nos. 2005/0079574, 2005/0119455, 2005/0266000, 2007/0117126, 2007/0160598, 2007/0237764, 2007/0292936, and 2009/0002360.

Antibodies or antibody fragments isolated from human antibody libraries are considered human antibodies or human antibody fragments herein.

6. Multispecific Antibodies

In certain embodiments, an antibody provided herein is a multispecific antibody, e.g., a bispecific antibody. Multispecific antibodies are monoclonal antibodies that have binding specificities for at least two different sites. In certain embodiments, one of the binding specificities is for CTLA-4 and the other is for any other antigen. In certain embodiments, bispecific antibodies may bind to two different epitopes of CTLA-4. Bispecific antibodies may also be used to localize cytotoxic agents to cells which express CTLA-4. Bispecific antibodies can be prepared as full length antibodies or antibody fragments.

Techniques for making multispecific antibodies include, but are not limited to, recombinant co-expression of two immunoglobulin heavy chain-light chain pairs having different specificities (see Milstein and Cuello, *Nature* 305:537 (1983)), WO 93/08829, and Traunecker et al., *EMBO J.* 10:3655 (1991)), and "knob-in-hole" engineering (see, e.g., U.S. Pat. No. 5,731,168). Multi-specific antibodies may also be made by engineering electrostatic steering effects for making antibody Fc-heterodimeric molecules (WO 2009/089004A1); cross-linking two or more antibodies or fragments (see, e.g., U.S. Pat. No. 4,676,980, and Brennan et al., *Science*, 229:81 (1985)); using leucine zippers to produce bi-specific antibodies (see, e.g., Kostelny et al., *J. Immunol.*, 148 (5): 1547-1553 (1992)); using "diabody" technology for making bispecific antibody fragments (see, e.g., Hollinger et al., *Proc. Natl. Acad. Sci. USA*, 90:6444-6448 (1993)); and using single-chain Fv (scFv) dimers (see, e.g., Gruber et al., *J. Immunol.*, 152:5368 (1994)); and preparing trispecific antibodies as described, e.g., in Tutt et al., *J. Immunol.* 147:60 (1991).

Engineered antibodies with three or more functional antigen binding sites, including "Octopus antibodies," are also included herein (see, e.g., US 2006/0025576A1).

The antibody or fragment herein also includes a "Dual Acting Fab" or "DAF" comprising an antigen binding site that binds to CTLA-4 as well as another, different antigen (see, US 2008/0069820, for example).

7. Antibody Variants

In certain embodiments, amino acid sequence variants of the antibodies provided herein are contemplated. For example, it may be desirable to improve the binding affinity and/or other biological properties of the antibody. Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding.

a) Substitution, Insertion, and Deletion Variants

In certain embodiments, antibody variants having one or more amino acid substitutions are provided. Sites of interest for substitutional mutagenesis include the HVRs and FRs. Conservative substitutions are shown in Table 1 under the heading of "preferred substitutions." More substantial changes are provided in Table 1 under the heading of "exemplary substitutions," and as further described below in reference to amino acid side chain classes. Amino acid substitutions may be introduced into an antibody of interest and the products screened for a desired activity, e.g., retained/improved antigen binding, decreased immunogenicity, or improved ADCC or CDC.

TABLE 1

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids can be classified into groups according to their common side chain properties:
(1) Hydrophobic: norleucine, methionine (Met), alanine (Ala), valine (Val), leucine (Leu), and isoleucine (Ile);
(2) Neutral and hydrophilic: cysteine (Cys), serine (Ser), threonine (Thr), asparagine (Asn), and glutamine (Gln);
(3) Acidic: aspartate (Asp) and glutamate (Glu);
(4) Basic: histidine (His), lysine (Lys), and arginine (Arg);
(5) Residues that influence the chain orientation: glycine (Gly) and proline (Pro); and
(6) Aromatic: tryptophan (Trp), tyrosine (Tyr), and phenylalanine (Phe).

Non-conservative substitution refers to the replacement of a member of one of these classes with one of another class.

One type of substitutional variant involves substituting one or more hypervariable region residues of a parent antibody (e.g., a humanized or human antibody). Generally, the resulting variant(s) selected for further study will have modifications (e.g., improvements) in certain biological properties (e.g., increased affinity, reduced immunogenicity) relative to the parent antibody and/or will have substantially retained certain biological properties of the parent antibody. An exemplary substitutional variant is an affinity matured antibody, which may be conveniently generated, e.g., using phage display-based affinity maturation techniques such as those described herein. Briefly, one or more HVR residues are mutated and the variant antibodies displayed on phage and screened for a particular biological activity (e.g., binding affinity).

Alterations (e.g., substitutions) may be made in HVRs, e.g., to improve antibody affinity. Such alterations may be made in HVR "hotspots," i.e., residues encoded by codons that undergo mutation at high frequency during the somatic maturation process (see, e.g., Chowdhury, *Methods Mol. Biol.* 207:179-196 (2008)), and/or residues that contact antigen, with the resulting variant VH or VL being tested for binding affinity. Affinity maturation by constructing and reselecting from secondary libraries has been described, e.g., in Hoogenboom et al., in *Methods in Molecular Biology* 178:1-37 (O'Brien et al., ed., *Human Press*, Totowa, NJ, (2001)). In some embodiments of affinity maturation, diversity is introduced into the variable genes chosen for maturation by any of a variety of methods (e.g., error-prone PCR, chain shuffling, or oligonucleotide-directed mutagenesis). A secondary library is then created. The library is then screened to identify any antibody variants with the desired affinity. Another method to introduce diversity involves HVR-directed approaches, in which several HVR residues (e.g., 4-6 residues at a time) are randomized. HVR residues involved in antigen binding may be specifically identified, e.g., using alanine scanning mutagenesis or modeling. CDR-H3 and CDR-L3 in particular are often targeted.

In certain embodiments, substitutions, insertions, or deletions may occur within one or more HVRs so long as such alterations do not substantially reduce the ability of the antibody to bind antigen. For example, conservative alterations (e.g., conservative substitutions as provided herein) that do not substantially reduce binding affinity may be made in HVRs. Such alterations may, for example, be outside of antigen contacting residues in the HVRs. In certain embodiments of the variant VH and VL sequences provided above, each HVR either is unaltered, or contains no more than one, two or three amino acid substitutions.

A useful method for identification of residues or regions of an antibody that may be targeted for mutagenesis is called "alanine scanning mutagenesis" as described by Cunningham and Wells (1989) *Science*, 244:1081-1085. In this method, a residue or group of target residues (e.g., charged residues such as arg, asp, his, lys, and glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antibody complex may be analyzed to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion of an enzyme (e.g., for ADEPT) or a polypeptide which increases the plasma half-life of the antibody to the N- or C-terminus of the antibody.

b) Glycosylation Variants

In certain embodiments, an antibody provided herein is altered to increase or decrease the extent to which the antibody is glycosylated. Addition or deletion of glycosylation sites to an antibody may be conveniently accomplished by altering the amino acid sequence such that one or more glycosylation sites is created or removed.

Where the antibody comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al., *TIBTECH* 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in an antibody of the present invention may be made in order to create antibody variants with certain improved properties.

In one embodiment, antibody variants are provided having a carbohydrate structure that lacks fucose attached (directly or indirectly) to an Fc region. For example, the amount of fucose in such antibody may be from 1% to 80%, from 1% to 65%, from 5% to 65% or from 20% to 40%. The amount of fucose is determined by calculating the average amount of fucose within the sugar chain at Asn297, relative to the sum of all glycostructures attached to Asn 297 (e.g., complex, hybrid and high mannose structures) as measured by MALDI-TOF mass spectrometry, as described in WO 2008/077546, for example. Asn297 refers to the asparagine residue located at about position 297 in the Fc region (EU numbering of Fc region residues); however, Asn297 may also be located about +/−3 amino acids upstream or downstream of position 297, i.e., between positions 294 and 300, due to minor sequence variations in antibodies. Such fucosylation variants may have improved ADCC function. See, e.g., US Patent Publication Nos. US 2003/0157108 (Presta, L.); US 2004/0093621 (Kyowa Hakko Kogyo Co., Ltd). Examples of publications related to "defucosylated" or "fucose-deficient" antibody variants include: US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; WO2002/031140; Okazaki et al., *J. Mol. Biol.* 336:1239-1249 (2004); Yamane-Ohnuki et al., *Biotech. Bioeng.* 87:614 (2004). Examples of cell lines capable of producing defucosylated antibodies include Lec13 CHO cells deficient in protein fucosylation (Ripka et al., *Arch. Biochem. Biophys.* 249: 533-545 (1986); US Pat Appl No US 2003/0157108 A1, Presta, L; and WO 2004/056312 A1, Adams et al., especially at Example 11), and knockout cell lines, such as alpha-1,6- fucosyltransferase gene, FUT8, knockout CHO cells (see, e.g., Yamane-Ohnuki et al., *Biotech. Bioeng.* 87:614 (2004); Kanda, Y. et al., *Biotechnol. Bioeng.*, 94 (4): 680-688 (2006); and WO 2003/085107).

Antibodies variants are further provided with bisected oligosaccharides, e.g., in which a biantennary oligosaccharide attached to the Fc region of the antibody is bisected by GlcNAc. Such antibody variants may have reduced fucosylation and/or improved ADCC function. Examples of such antibody variants are described, e.g., in WO 2003/011878 (Jean-Mairet et al.); U.S. Pat. No. 6,602,684 (Umana et al.); and US 2005/0123546 (Umana et al.). Antibody variants with at least one galactose residue in the oligosaccharide attached to the Fc region are also provided. Such antibody variants may have improved CDC function. Such antibody variants are described, e.g., in WO 1997/30087 (Patel et al.); WO 1998/58964 (Raju, S.); and WO 1999/22764 (Raju, S.).

c) Fc Region Variants

In certain embodiments, one or more amino acid modifications may be introduced into the Fc region of an antibody provided herein, thereby generating an Fc region variant. The Fc region variant may comprise a human Fc region sequence (e.g., a human IgG1, IgG2, IgG3 or IgG4 Fc region) comprising an amino acid modification (e.g., a substitution) at one or more amino acid positions.

In certain embodiments, the present invention contemplates an antibody variant that possesses some but not all effector functions, which make it a desirable candidate for applications in which the half life of the antibody in vivo is important yet certain effector functions (such as complement and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the antibody lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g., Hellstrom, I. et al., *Proc. Nat'l Acad. Sci. USA* 83:7059-7063 (1986)) and Hellstrom, I et al., *Proc. Nat'l Acad. Sci. USA* 82:1499-1502 (1985); U.S. Pat. No. 5,821,337 (see Bruggemann, M. et al., *J. Exp. Med.* 166:1351-1361 (1987)). Alternatively, non-radioactive assays methods may be employed (see, for example, ACT1™ non-radioactive cytotoxicity assay for flow cytometry (CellTechnology, Inc. Mountain View, CA; and CytoTox 96 (registered trademark) non-radioactive cytotoxicity assay (Promega, Madison, WI). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al., *Proc. Nat'l Acad. Sci. USA* 95:652-656 (1998). C1q binding assays may also be carried out to confirm that the antibody is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101:1045-1052 (2003); and Cragg, M. S. and M. J. Glennie, *Blood* 103:2738-2743 (2004)). FcRn binding and in vivo clearance/half life determinations can also be performed using methods known in the art (see, e.g., Petkova, S. B. et al., *Int'l. Immunol.* 18 (12): 1759-1769 (2006)).

Antibodies with reduced effector function include those with substitution of one or more of Fc region residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581).

Certain antibody variants with increased or decreased binding to FcRs are described (See, e.g., U.S. Pat. No. 6,737,056; WO 2004/056312, and Shields et al., *J. Biol. Chem.* 9 (2): 6591-6604 (2001)).

In certain embodiments, an antibody variant comprises an Fc region with one or more amino acid substitutions which improve ADCC, e.g., substitutions at positions 298, 333, and/or 334 of the Fc region (EU numbering of residues).

In some embodiments, alterations are made in the Fc region that result in altered (i.e., either increased or decreased) C1q binding and/or Complement Dependent Cytotoxicity (CDC), e.g., as described in U.S. Pat. No. 6,194,551, WO 99/51642, and Idusogie et al., *J. Immunol.* 164:4178-4184 (2000).

Antibodies with increased half lives and increased binding to the neonatal Fc receptor (FcRn), which is responsible for the transfer of maternal IgGs to the fetus (Guyer et al., *J. Immunol.* 117:587 (1976); and Kim et al., *J. Immunol.* 24:249 (1994)), are described in US2005/0014934A1 (Hinton et al.). Those antibodies comprise an Fc region with one or more substitutions therein which increase binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826).

See also Duncan & Winter, *Nature* 322:738-740 (1988); U.S. Pat. Nos. 5,648,260; 5,624,821; and WO 94/29351 concerning other examples of Fc region variants.

d) Cysteine Engineered Antibody Variants

In certain embodiments, it may be desirable to create cysteine engineered antibodies, e.g., "thioMAbs," in which one or more residues of an antibody are substituted with cysteine residues. In particular embodiments, the substituted residues occur at accessible sites of the antibody. By substituting those residues with cysteine, reactive thiol groups are thereby positioned at accessible sites of the antibody and may be used to conjugate the antibody to other moieties, such as drug moieties or linker-drug moieties, to create an immunoconjugate, as described further herein. In certain embodiments, any one or more of the following residues may be substituted with cysteine: V205 (Kabat numbering) of the light chain; A118 (EU numbering) of the heavy chain; and S400 (EU numbering) of the heavy chain Fc region. Cysteine engineered antibodies may be generated as described, e.g., in U.S. Pat. No. 7,521,541.

e) Antibody Derivatives

In certain embodiments, an antibody provided herein may be further modified to contain additional nonproteinaceous moieties that are known in the art and readily available. The moieties suitable for derivatization of the antibody include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone) polyethylene glycol, polypropylene glycol homopolymers, polypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer are attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

In another embodiment, conjugates of an antibody and nonproteinaceous moiety that may be selectively heated by exposure to radiation are provided. In one embodiment, the nonproteinaceous moiety is a carbon nanotube (Kam et al., *Proc. Natl. Acad. Sci. USA* 102:11600-11605 (2005)). The radiation may be of any wavelength, and includes, but is not limited to, wavelengths that do not harm ordinary cells, but which heat the nonproteinaceous moiety to a temperature at which cells proximal to the antibody-nonproteinaceous moiety are killed.

It is possible to combine the anti-CTLA-4 antibody herein with various existing technologies. One non-limiting embodiment of such a combination with technologies is, for example, production of cells expressing a chimeric antigen receptor (CAR) utilizing the anti-CTLA-4 antibody. Here, examples of cells include T cells, γδ T cells, NK cells, NKT cells, cytokine-induced killer (CIK) cells, and macrophages (Int J Mol Sci. (2019) 20 (11), 2839, Nat Rev Drug Discov. (2020) 19 (5), 308). One non-limiting example of a method of producing the CAR-expressing T cell (CAR-T) includes a method of introducing a CAR that comprises an antigen-binding domain of the anti-CTLA-4 antibody (e.g., scFv), the transmembrane domain of TCR, and the signaling domain of a co-stimulatory molecule such as CD28 to enhance T cell activation, into effector cells such as T cells by gene modification techniques.

Non-limiting examples of technologies that can be combined with the anti-CTLA-4 antibody herein include production of a T cell-redirecting antibody utilizing the anti-CTLA-4 antibody (Nature (1985) 314 (6012), 628-31, Int J Cancer (1988) 41 (4), 609-15, Proc Natl Acad Sci USA (1986) 83 (5), 1453-7). One non-limiting embodiment of the T cell-redirecting antibody is a bispecific antibody comprising: a binding domain against any of subunits constituting a T cell receptor (TCR) complex on T cells, in particular, a binding domain against a CD3 epsilon chain among CD3; and an antigen binding domain of the anti-CTLA-4 antibody.

B. Recombinant Methods and Compositions

Antibodies may be produced using recombinant methods and compositions, e.g., as described in U.S. Pat. No. 4,816,567. In one embodiment, isolated nucleic acid encoding an anti-CTLA-4 antibody described herein is provided. Such nucleic acid may encode an amino acid sequence comprising the VL and/or an amino acid sequence comprising the VH of the antibody (e.g., the light and/or heavy chains of the antibody). In a further embodiment, one or more vectors (e.g., expression vectors) comprising such nucleic acid are provided. In a further embodiment, a host cell comprising such nucleic acid is provided. In one such embodiment, a host cell comprises (e.g., has been transformed with): (1) a vector comprising a nucleic acid that encodes an amino acid sequence comprising the VL of the antibody and an amino acid sequence comprising the VH of the antibody, or (2) a first vector comprising a nucleic acid that encodes an amino acid sequence comprising the VL of the antibody and a second vector comprising a nucleic acid that encodes an amino acid sequence comprising the VH of the antibody. In one embodiment, the host cell is eukaryotic, e.g., a Chinese Hamster Ovary (CHO) cell or lymphoid cell (e.g., Y0, NS0, Sp2/0 cell). In one embodiment, a method of making an anti-CTLA-4 antibody is provided, wherein the method comprises culturing a host cell comprising a nucleic acid encoding the antibody, as provided above, under conditions suitable for expression of the anti-CTLA-4 antibody, and optionally recovering the antibody from the host cell (or host cell culture medium).

For recombinant production of an anti-CTLA-4 antibody, nucleic acid encoding an antibody, e.g., as described above, is isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the heavy and light chains of the antibody).

Suitable host cells for cloning or expression of antibody-encoding vectors include prokaryotic or eukaryotic cells described herein. For example, antibodies may be produced in bacteria, in particular when glycosylation and Fc effector function are not needed. For expression of antibody fragments and polypeptides in bacteria, see, e.g., U.S. Pat. Nos. 5,648,237, 5,789,199, and 5,840,523 (See also Charlton, *Methods in Molecular Biology, Vol.* 248 (B. K. C. Lo, ed., Humana Press, Totowa, NJ, 2003), pp. 245-254, describing expression of antibody fragments in *E. coli*). After expression, the antibody may be isolated from the bacterial cell paste in a soluble fraction and can be further purified.

In addition to prokaryotes, eukaryotic microbes such as filamentous fungi or yeast are suitable cloning or expression hosts for antibody-encoding vectors, including fungi and yeast strains whose glycosylation pathways have been "humanized," resulting in the production of an antibody with a partially or fully human glycosylation pattern. See Gerngross, *Nat. Biotech.* 22:1409-1414 (2004), and Li et al., *Nat. Biotech.* 24:210-215 (2006).

Suitable host cells for the expression of glycosylated antibody are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells.

Plant cell cultures can also be utilized as hosts. See, e.g., U.S. Pat. Nos. 5,959,177, 6,040,498, 6,420,548, 7,125,978, and 6,417,429 (describing PLANTIBODIES™ technology for producing antibodies in transgenic plants).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., *J. Gen Virol.* 36:59 (1977)); baby hamster kidney cells (BHK); mouse sertoli cells (TM4 cells as described, e.g., in Mather, *Biol. Reprod.* 23:243-251 (1980)); monkey kidney cells (CV1); African green monkey kidney cells (VERO-76); human cervical carcinoma cells (HELA); canine kidney cells (MDCK); buffalo rat liver cells (BRL 3A); human lung cells (W138); human liver cells (Hep G2); mouse mammary tumor (MMT 060562); TRI cells, as described, e.g., in Mather et al., *Annals N.Y. Acad. Sci.* 383:44-68 (1982); MRC 5 cells; and FS4 cells. Other useful mammalian host cell lines include Chinese hamster ovary (CHO) cells, including DHFR CHO cells (Urlaub et al., *Proc. Natl. Acad. Sci. USA* 77:4216 (1980)); and myeloma cell lines such as Y0, NS0 and Sp2/0. For a review of certain mammalian host cell lines suitable for antibody production, see, e.g., Yazaki and Wu, *Methods in Molecular Biology*, Vol. 248 (B. K. C. Lo, ed., Humana Press, Totowa, NJ), pp. 255-268 (2003).

Polyclonal antibodies are preferably raised in animals by multiple subcutaneous (sc) or intraperitoneal (ip) injections of the relevant antigen and an adjuvant. It may be useful to conjugate the relevant antigen to a protein that is immunogenic in the species to be immunized, e.g., keyhole limpet hemocyanin, serum albumin, bovine thyroglobulin, or soybean trypsin inhibitor using a bifunctional or derivatizing agent, for example, maleimidobenzoyl sulfosuccinimide ester (conjugation through cysteine residues), N-hydroxysuccinimide (through lysine residues), glutaraldehyde, succinic anhydride, $SOCl_2$, or $R^1N=C=NR$, where R and $R^1$ are different alkyl groups.

Animals (usually non-human mammals) are immunized against the antigen, immunogenic conjugates, or derivatives by combining, e.g., 100 μg or 5 μg of the protein or conjugate (for rabbits or mice, respectively) with 3 volumes of Freund's complete adjuvant and injecting the solution intradermally at multiple sites. One month later the animals are boosted with ⅕ to ⅒ the original amount of peptide or conjugate in Freund's complete adjuvant by subcutaneous injection at multiple sites. Seven to 14 days later the animals are bled, and the serum is assayed for antibody titer. Animals are boosted until the titer plateaus. Preferably, the animal is boosted with the conjugate of the same antigen, but conjugated to a different protein and/or through a different cross-linking reagent. Conjugates also can be prepared in recombinant cell culture as protein fusions. Also, aggregating agents such as alum are suitably used to enhance the immune response.

Monoclonal antibodies are obtained from a population of substantially homogeneous antibodies, i.e., the individual antibodies constituting the population are identical except for possible naturally occurring mutations and/or post-translational modifications (e.g., isomerizations, amidations) that may be present in minor amounts. Thus, the modifier "monoclonal" indicates the character of the antibody as not being a mixture of discrete antibodies.

For example, the monoclonal antibodies may be made using the hybridoma method first described by Kohler et al., Nature 256 (5517): 495-497 (1975). In the hybridoma method, a mouse or other appropriate host animal, such as a hamster, is immunized as hereinabove described to elicit lymphocytes that produce or are capable of producing antibodies that specifically bind to the protein used for immunization. Alternatively, lymphocytes may be immunized in vitro.

The immunizing agent typically includes the antigenic protein or a fusion variant thereof. Generally, either peripheral blood lymphocytes (PBLs) are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell (Goding, Monoclonal Antibodies: Principles and Practice, Academic Press (1986), pp. 59-103).

Immortalized cell lines are usually transformed mammalian cells, particularly myeloma cells of rodent, bovine and human origin. Usually, rat or mouse myeloma cell lines are employed. The hybridoma cells thus prepared are seeded and grown in a suitable culture medium that preferably contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which are substances that prevent the growth of HGPRT-deficient cells.

Preferred immortalized myeloma cells are those that fuse efficiently, support stable high-level production of antibody by the selected antibody-producing cells, and are sensitive to a medium such as HAT medium. Among these, preferred are murine myeloma lines, such as those derived from MOPC-21 and MPC-11 mouse tumors available from the Salk Institute Cell Distribution Center, San Diego, California USA, and SP-2 cells (and derivatives thereof, e.g., X63-Ag8-653) available from the American Type Culture Collection, Manassas, Virginia USA. Human myeloma and mouse-human heteromyeloma cell lines also have been described for the production of human monoclonal antibodies (Kozbor et al., J. Immunol. 133 (6): 3001-3005 (1984); Brodeur et al., Monoclonal Antibody Production Techniques and Applications, Marcel Dekker, Inc., New York, pp. 51-63 (1987)).

Culture medium in which hybridoma cells are growing is assayed for production of monoclonal antibodies against the antigen. Preferably, the binding specificity of monoclonal antibodies produced by hybridoma cells is determined by immunoprecipitation or by an in vitro binding assay, such as radioimmunoassay (RIA) or enzyme-linked immunosorbent assay (ELISA). Such techniques and assays are known in the art. For example, binding affinity may be determined by the Scatchard analysis of Munson, Anal. Biochem. 107 (1): 220-239 (1980).

After hybridoma cells are identified that produce antibodies of the desired specificity, affinity, and/or activity, the clones may be subcloned by limiting dilution procedures and grown by standard methods (Goding, supra). Suitable culture media for this purpose include, for example, D-MEM or RPMI-1640 medium. In addition, the hybridoma cells may be grown in vivo as tumors in a mammal.

The monoclonal antibodies secreted by the subclones are suitably separated from the culture medium, ascites fluid, or serum by conventional immunoglobulin purification procedures such as, for example, Protein A-Sepharose, hydroxyapatite chromatography, gel electrophoresis, dialysis, or affinity chromatography.

Antibodies may be produced by immunizing an appropriate host animal against an antigen. In one embodiment, the antigen is a polypeptide comprising a full-length CTLA-4. In one embodiment, the antigen is a polypeptide comprising soluble CTLA-4. In one embodiment, the antigen is a polypeptide comprising the region corresponding to the amino acids from position 97 (Glu) to position 106 (Leu) of human CTLA-4 (extracellular domain, SEQ ID NO: 28). In one embodiment, the antigen is a polypeptide comprising the region corresponding to the amino acids from position 99 (Met) to position 106 (Leu) of human CTLA-4 (extracellular domain, SEQ ID NO: 28). Also included in the present invention are antibodies produced by immunizing an animal against the antigen. The antibodies may incorporate any of the features, singly or in combination, as described in "Exemplary Anti-CTLA-4 Antibodies" above.

C. Assays

Anti-CTLA-4 antibodies provided herein may be identified, screened for, or characterized for their physical/chemical properties and/or biological activities by various assays known in the art.

1. Binding Assays and Other Assays

In one aspect, an antibody of the present invention is tested for its antigen binding activity, e.g., by known methods such as ELISA, Western blot, surface plasmon resonance assay, etc.

In another aspect, competition assays may be used to identify an antibody that competes with anti-CTLA-4 antibodies described herein (for example, anti-CTLA-4 antibodies described in Table 20, Table 25, Table 30, and Table 35) for binding to CTLA-4. In certain embodiments, if such a competing antibody exists excessively, binding of reference antibody to CTLA-4 is prevented (e.g., reduced) at least 10%, 15%, 20%, 25%, 30%, 35%, 40%, 45%, 50%, 55%, 60%, 65%, 70%, 75%, or above. In some examples, binding is prevented at least 80%, 85%, 90%, 95%, or above. In certain embodiments, such a competing antibody binds to the same epitope (e.g., a linear or a conformational epitope) that is bound by anti-CTLA-4 antibodies described herein (for example, anti-CTLA-4 antibodies described in Table 20, Table 25, Table 30, and Table 35). Detailed exemplary methods for mapping an epitope to which an antibody binds are provided in Morris (1996) "Epitope Mapping Protocols," in *Methods in Molecular Biology* vol. 66 (Humana Press, Totowa, NJ).

In an exemplary competition assay, immobilized CTLA-4 is incubated in a solution comprising a first labeled antibody that binds to CTLA-4 and a second unlabeled antibody that is being tested for its ability to compete with the first antibody for binding to CTLA-4. The second antibody may be present in a hybridoma supernatant. As a control, immobilized CTLA-4 is incubated in a solution comprising the first labeled antibody but not the second unlabeled antibody. After incubation under conditions permissive for binding of the first antibody to CTLA-4, excess unbound antibody is removed, and the amount of label associated with immobilized CTLA-4 is measured. If the amount of label associated with immobilized CTLA-4 is substantially reduced in the test sample relative to the control sample, then that indicates that the second antibody is competing with the first antibody for binding to CTLA-4. See Harlow and Lane (1988) *Antibodies: A Laboratory Manual* ch.14 (Cold Spring Harbor Laboratory, Cold Spring Harbor, NY).

2. Activity Assays

In one aspect, assays are provided for identifying anti-CTLA-4 antibodies thereof having biological activity. Biological activity may include, e.g., cell proliferation-inhibitory activity, cytotoxic activity (for example, ADCC/CDC activity and ADCP activity), immunostimulatory activity, and CTLA-4 inhibitory activity. Antibodies having such biological activity in vivo and/or in vitro are also provided.

In certain embodiments, an antibody of the present invention is tested for such biological activity.

In certain embodiments, an antibody of the present invention is tested for its ability to inhibit cell growth or proliferation in vitro. Assays for inhibition of cell growth or proliferation are well known in the art. Certain assays for cell proliferation, exemplified by the "cell killing" assays described herein, measure cell viability. One such assay is the CellTiter-Glo™ Luminescent Cell Viability Assay, which is commercially available from Promega (Madison, WI). That assay determines the number of viable cells in culture based on quantitation of ATP present, which is an indication of metabolically active cells. See Crouch et al. (1993) *J. Immunol. Meth.* 160:81-88, U.S. Pat. No. 6,602,677. The assay may be conducted in 96- or 384-well format, making it amenable to automated high-throughput screening (HTS). See Cree et al. (1995) *AntiCancer Drugs* 6:398-404. The assay procedure involves adding a single reagent (CellTiter-Glo (registered trademark) Reagent) directly to cultured cells. This results in cell lysis and generation of a luminescent signal produced by a luciferase reaction. The luminescent signal is proportional to the amount of ATP present, which is directly proportional to the number of viable cells present in culture. Data can be recorded by luminometer or CCD camera imaging device. The luminescence output is expressed as relative light units (RLU).

Another assay for cell proliferation is the "MTT" assay, a colorimetric assay that measures the oxidation of 3-(4,5-dimethylthiazol-2-yl)-2,5-diphenyltetrazolium bromide to formazan by mitochondrial reductase. Like the CellTiter-Glo™ assay, this assay indicates the number of metabolically active cells present in a cell culture. See, e.g., Mosmann (1983) *J. Immunol. Meth.* 65:55-63, and Zhang et al. (2005) *Cancer Res.* 65:3877-3882.

Cells for use in any of the above in vitro assays include cells or cell lines that naturally express CTLA-4 or that have been engineered to express CTLA-4. Such cells also include cell lines that express CTLA-4 and cell lines that do not normally express CTLA-4 but have been transfected with nucleic acid encoding CTLA-4.

In one aspect, an anti-CTLA-4 antibody thereof is tested for its ability to inhibit cell growth or proliferation in vivo. In certain embodiments, an anti-CTLA-4 antibody thereof is tested for its ability to inhibit tumor growth in vivo. In vivo model systems, such as xenograft models, can be used for such testing. In an exemplary xenograft system, human tumor cells are introduced into a suitably immunocompromised non-human animal, e.g., an athymic "nude" mouse. An antibody of the present invention is administered to the animal. The ability of the antibody to inhibit or decrease tumor growth is measured. In certain embodiments of the above xenograft system, the human tumor cells are tumor cells from a human patient. Such xenograft models are commercially available from Oncotest GmbH (Frieberg, Germany). In certain embodiments, the human tumor cells are introduced into a suitably immunocompromised non-human animal by subcutaneous injection or by transplantation into a suitable site, such as a mammary fat pad.

It is understood that any of the above assays may be carried out using an immunoconjugate of the present invention in place of or in addition to an anti-CTLA-4 antibody.

A typical assay for measuring the ADCC activity of a therapeutic antibody is based on the $^{51}$Cr release assay and comprises the following steps: labeling target cells with [$^{51}$Cr]Na$_2$CrO$_4$; opsonizing the target cells expressing an antigen on their cell surface with an antibody; combining the opsonized radiolabeled target cells with effector cells in an appropriate ratio in a microtiter plate in the presence or absence of a test antibody; incubating the cell mixture preferably for 16 hours to 18 hours, preferably at 37° C.; collecting the supernatant; and analyzing the radioactivity in the supernatant sample. Then, the cytotoxicity of the test antibody is determined, for example, by the following equation: specific cytotoxicity rate (%)=(radioactivity in the presence of antibody−radioactivity in the absence of antibody)/(maximum radioactivity−radioactivity in the absence of antibody)×100. A graph can be produced by changing the target cell-to-effector cell ratio or the antibody concentration.

To evaluate complement activation, a complement-dependent cytotoxicity (CDC) assay can be performed as described in, for example, Gazzano-Santoro et al., J. Immunol. Methods 202:163 (1996). Briefly, various concentrations of a polypeptide variant and a human complement are diluted with buffer. Cells expressing an antigen to which the polypeptide variant binds are diluted up to a density of about $1\times10^6$ cells/ml. A mixture of the polypeptide variant, diluted human complement, and antigen-expressing cells is added to a flat-bottomed tissue culture 96-well plate and incubated at 37° C. and 5% $CO_2$ for 2 hours to promote complement-mediated cell lysis. Then, 50 µl of Alamar Blue (Accumed International) is added to each well and incubated at 37° C. overnight. Absorbance is measured using a 96-well fluorometer with excitation at 530 nm and emission at 590 nm. The results are represented in relative fluorescence units (RFU). The sample concentrations can be calculated from a standard curve, and the percent activity compared to the non-variant polypeptide is reported for the polypeptide variant of interest.

An exemplary assay method for ADCP activity can comprise the following: coating target bioparticles, such as *E. coli* labeled with FITC (Molecular Probes) or *Staphylococcus aureus*-FITC, with a test antibody; forming opsonized particles; adding the above opsonized particles to THP-1 effector cells (monocytic cell line, available from ATCC) at a ratio of 1:1, 10:1, 30:1, 60:1, 75:1, or 100:1 to induce FcγR-mediated phagocytosis; preferably incubating the cells and *E. coli*-FITC/antibody at 37° C. for 1.5 hours; after incubation, adding trypan blue to the cells (preferably at room temperature for two to three minutes) to quench the fluorescence of the bacteria which have not been incorporated into the cells and have attached to the outside of the cell surface; transferring the cells into FACS buffer (e.g., 0.1% BSA and 0.1% sodium azide in PBS) to assay the fluorescence of the THP-1 cells using FACS (e.g., BD FACS Calibur). To assay the extent of ADCP, the gate is preferably set on the THP-1 cells and the median fluorescence intensity is measured. In the most preferred embodiment, the ADCP assay is performed using *E. coli*-FITC in a medium (control); *E. coli*-FITC and THP-1 cells (used as FcγR-independent ADCP activity); and *E. coli*-FITC, THP-1 cells, and a test antibody (used as FcγR-dependent ADCP activity).

Cytotoxic activity by an antibody usually involves the binding of the antibody to the cell surface. Whether an antigen is expressed on the surface of the target cell can suitably be confirmed by methods known to those skilled in the art, such as FACS.

Activation of immunity can be detected by using cellular or humoral immune responses as indicators. Activation of immunity specifically includes increased expression level of cytokines (e.g., IL-6, G-CSF, IL-12, TNFα, and IFNγ) or their receptors, promoted proliferation of immune cells (e.g., B cells, T cells, NK cells, macrophages, and monocytes), elevated activation state, elevated functions, and enhanced cytotoxic activity. Especially, T cell activation can be detected by measuring elevated expressions of activation markers such as CD25, CD69, and ICOS. For example, it is known that patients who were administered with an anti-CTLA-4 antibody, ipilimumab, have increased $ICOS^+ CD4^+$ T cells in the peripheral blood after the administration, and this is considered to be an effect of activation of the systemic immune state by administration of the anti-CTLA-4 antibody (Cancer Immunol. Res. (2013) 1 (4): 229-234).

T cell activation requires not only stimulation through an antigen receptor (TCR), but also auxiliary stimulation through CD28. When CD28 on the surface of a T cell binds to B7-1 (CD80) or B7-2 (CD86) on the surface of an antigen-presenting cell, auxiliary signal is transmitted to the T cell and then the T cell is activated. On the other hand, CTLA-4 is expressed on the surface of activated T cells. Since CTLA-4 binds to CD80 and CD86 with stronger affinity than that of CD28, it interacts with CD80 and CD86 in preference to CD28, resulting in suppression of T cell activation.

Based on such action mechanism, inhibitory activity against CTLA-4 can be measured as the activity of inhibiting the binding of CTLA-4 to CD80 or CD86. In one embodiment, an assay for measuring inhibitory activity against CTLA-4 comprises the following steps: allowing a purified CTLA-4 protein to bind to a support such as a microtiter plate or magnetic beads; adding a test antibody and labeled soluble CD80 or CD86; washing out unbound components; and quantifying the bound labeled CD80 or CD86. Whether the test antibody cross-reacts with CD28 or not can be confirmed by performing a similar assay in which CD28 is used instead of CTLA-4. Moreover, in another embodiment, a functional assay which detects T cell activation as described above can also be used to measure inhibitory activity against CTLA-4. For example, when a test antibody having CTLA-4 inhibitory activity is added to a system in which T cell activation is measured by stimulating a T cell population with cells expressing CD80 or CD86, T cell activation is further enhanced.

D. Immunoconjugates

The present invention also provides immunoconjugates comprising an anti-CTLA-4 antibody herein conjugated to one or more cytotoxic agents, such as chemotherapeutic agents or drugs, growth inhibitory agents, toxins (e.g., protein toxins, enzymatically active toxins of bacterial, fungal, plant, or animal origin, or fragments thereof), or radioactive isotopes.

In one embodiment, an immunoconjugate is an antibody-drug conjugate (ADC) in which an antibody is conjugated to one or more drugs, including but not limited to a maytansinoid (see U.S. Pat. Nos. 5,208,020, 5,416,064 and European Patent EP 0 425 235 B1); an auristatin such as monomethylauristatin drug moieties DE and DF (MMAE and MMAF) (see U.S. Pat. Nos. 5,635,483 and 5,780,588, and 7,498,298); a dolastatin; a calicheamicin or derivative thereof (see U.S. Pat. Nos. 5,712,374, 5,714,586, 5,739,116, 5,767,285, 5,770,701, 5,770,710, 5,773,001, and 5,877,296; Hinman et al., *Cancer Res.* 53:3336-3342 (1993); and Lode et al., *Cancer Res.* 58:2925-2928 (1998)); an anthracycline such as daunomycin or doxorubicin (see Kratz et al., *Current Med. Chem.* 13:477-523 (2006); Jeffrey et al., *Bioorganic & Med. Chem. Letters* 16:358-362 (2006); Torgov et al., *Bioconj. Chem.* 16:717-721 (2005); Nagy et al., *Proc. Natl. Acad. Sci. USA* 97:829-834 (2000); Dubowchik et al., *Bioorg. & Med. Chem. Letters* 12:1529-1532 (2002); King et al., *J. Med. Chem.* 45:4336-4343 (2002); and U.S. Pat. No. 6,630,579); methotrexate; vindesine; a taxane such as docetaxel, paclitaxel, larotaxel, tesetaxel, and ortataxel; a trichothecene; and CC1065.

In another embodiment, an immunoconjugate comprises an antibody as described herein conjugated to an enzymatically active toxin or fragment thereof, including but not limited to diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins,

*Phytolacca americana* proteins (PAPI, PAPII, and PAP-S), *Momordica charantia* inhibitor, curcin, crotin, *Saponaria officinalis* inhibitor, gelonin, mitogellin, restrictocin, phenomycin, enomycin, and the tricothecenes.

In another embodiment, an immunoconjugate comprises an antibody as described herein conjugated to a radioactive atom to form a radioconjugate. A variety of radioactive isotopes are available for the production of radioconjugates. Examples include $^{211}$At, $^{131}$I, $^{125}$I, $^{90}$Y, $^{186}$Re, $^{188}$Re, $^{153}$Sm, $^{212}$Bi, $^{32}$P, $^{212}$Pb and radioactive isotopes of Lu. When the radioconjugate is used for detection, it may comprise a radioactive atom for scintigraphic studies, for example Tc-99m or $^{123}$I, or a spin label for nuclear magnetic resonance (NMR) imaging (also known as magnetic resonance imaging, MRI), such as iodine-123 again, iodine-131, indium-111, fluorine-19, carbon-13, nitrogen-15, oxygen-17, gadolinium, manganese or iron.

Conjugates of an antibody and cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., *Science* 238:1098 (1987). Carbon-14-labeled 1-isothiocyanatobenzyl-3-methyldiethylene triaminepentaacetic acid (MX-DTPA) is an exemplary chelating agent for conjugation of radionuclide to the antibody. See WO 94/11026. The linker may be a "cleavable linker" facilitating release of a cytotoxic drug in the cell. For example, an acid-labile linker, peptidase-sensitive linker, photolabile linker, dimethyl linker or disulfide-containing linker (Chari et al., *Cancer Res.* 52:127-131 (1992); U.S. Pat. No. 5,208,020) may be used.

The immunuoconjugates or ADCs herein expressly contemplate, but are not limited to such conjugates prepared with cross-linker reagents including, but not limited to, BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, IL., U.S.A).

E. Methods and Compositions for Diagnostics and Detection

In certain embodiments, any of the anti-CTLA-4 antibodies provided herein is useful for detecting the presence of CTLA-4 in a biological sample. The term "detecting" as used herein encompasses quantitative or qualitative detection. In certain embodiments, a biological sample comprises a cell or tissue, such as serum, whole blood, plasma, biopsy sample, tissue sample, cell suspension, saliva, sputum, oral fluid, cerebral fluid, amniotic fluid, ascites fluid, milk, colostrum, mammary secretion, lymph fluid, urine, sweat, lacrimal fluid, gastric juice, synovial fluid, ascites fluid, ocular fluid, and mucus.

In one embodiment, an anti-CTLA-4 antibody for use in a method of diagnosis or detection is provided. In a further aspect, a method of detecting the presence of CTLA-4 in a biological sample is provided. In certain embodiments, the method comprises contacting the biological sample with an anti-CTLA-4 antibody as described herein under conditions permissive for binding of the anti-CTLA-4 antibody to CTLA-4, and detecting whether a complex is formed between the anti-CTLA-4 antibody and CTLA-4. Such method may be an in vitro or in vivo method. In one embodiment, an anti-CTLA-4 antibody is used to select subjects eligible for therapy with an anti-CTLA-4 antibody, e.g., where CTLA-4 is a biomarker for selection of patients.

An antibody of the present invention may be used in, for example, checking the status of immune response and diagnosing immune system dysfunction.

In certain embodiments, labeled anti-CTLA-4 antibodies are provided. Labels include, but are not limited to, labels or moieties that are detected directly (such as fluorescent, chromophoric, electron-dense, chemiluminescent, and radioactive labels), as well as moieties, such as enzymes or ligands, that are detected indirectly, e.g., through an enzymatic reaction or molecular interaction. Exemplary labels include, but are not limited to, the radioisotopes $^{32}$P, $^{14}$C, $^{125}$I, $^{3}$H, and $^{131}$I, fluorophores such as rare earth chelates or fluorescein and its derivatives, rhodamine and its derivatives, dansyl, umbelliferone, luceriferases, e.g., firefly luciferase and bacterial luciferase (U.S. Pat. No. 4,737,456), luciferin, 2,3-dihydrophthalazinediones, horseradish peroxidase (HRP), alkaline phosphatase, beta-galactosidase, glucoamylase, lysozyme, saccharide oxidases, e.g., glucose oxidase, galactose oxidase, and glucose-6-phosphate dehydrogenase, heterocyclic oxidases such as uricase and xanthine oxidase, those coupled with an enzyme that employs hydrogen peroxide to oxidize a dye precursor such as HRP, lactoperoxidase, or microperoxidase, biotin/avidin, spin labels, bacteriophage labels, stable free radicals, and the like.

F. Pharmaceutical Formulations

Pharmaceutical formulations of an anti-CTLA-4 antibody as described herein are prepared by mixing such antibody having the desired degree of purity with one or more optional pharmaceutically acceptable carriers (*Remington's Pharmaceutical Sciences* 16th edition, Osol, A. Ed. (1980)), in the form of lyophilized formulations or aqueous solutions. Pharmaceutically acceptable carriers are generally nontoxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as polyethylene glycol (PEG). Exemplary pharmaceutically acceptable carriers herein further include interstitial drug dispersion agents such as soluble neutral-active hyaluronidase glycoproteins (sHASEGP). Certain exemplary sHASEGPs and methods of use are described in US Patent Publication Nos. 2005/0260186 and 2006/

0104968. In one aspect, a sHASEGP is combined with one or more additional glycosaminoglycanases such as chondroitinases.

Exemplary lyophilized antibody formulations are described in U.S. Pat. No. 6,267,958. Aqueous antibody formulations include those described in U.S. Pat. No. 6,171, 586 and WO 2006/044908, the latter formulations including a histidine-acetate buffer.

The formulation herein may also contain more than one active ingredients as necessary for the particular indication being treated, preferably those with complementary activities that do not adversely affect each other. Such active ingredients are suitably present in combination in amounts that are effective for the purpose intended.

Active ingredients may be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles and nanocapsules) or in macroemulsions. Such techniques are disclosed in *Remington's Pharmaceutical Sciences* 16th edition, Osol, A. Ed. (1980).

Sustained-release preparations may be prepared. Suitable examples of sustained-release preparations include semipermeable matrices of solid hydrophobic polymers containing the antibody, which matrices are in the form of shaped articles, e.g., films, or microcapsules.

The formulations to be used for in vivo administration are generally sterile. Sterility may be readily accomplished, e.g., by filtration through sterile filtration membranes.

G. Therapeutic Methods and Compositions

Any of the anti-CTLA-4 antibodies provided herein may be used in therapeutic methods.

In one aspect, an anti-CTLA-4 antibody for use as a medicament is provided. In further aspects, an anti-CTLA-4 antibody for use in treating tumor is provided. In certain embodiments, an anti-CTLA-4 antibody for use in a method of treatment is provided. In certain embodiments, the present invention provides an anti-CTLA-4 antibody for use in a method of treating an individual having tumor comprising administering to the individual an effective amount of the anti-CTLA-4 antibody. In one such embodiment, the method further comprises administering to the individual an effective amount of at least one additional therapeutic agent, e.g., as described below. In further embodiments, the present invention provides an anti-CTLA-4 antibody for use in damaging cells. In certain embodiments, the present invention provides an anti-CTLA-4 antibody for use in a method of damaging cells in an individual comprising administering to the individual an effective amount of the anti-CTLA-4 antibody to damage cells. In further embodiments, the present invention provides an anti-CTLA-4 antibody for use in immune activation. In certain embodiments, the present invention provides an anti-CTLA-4 antibody for use in a method of activating immunity in an individual comprising administering to the individual an effective amount of the anti-CTLA-4 antibody to activate immunity. An "individual" according to any of the above embodiments is preferably a human.

In some embodiments, the tumor is a solid tumor. In a solid tumor, tumor cells usually proliferate to form a population, and the tumor tissue is formed mainly by these cells. Furthermore, tumor tissues in living organisms are often infiltrated by immune cells such as lymphocytes, which also constitute part of tumor tissues. In some embodiments, tumor tissues are infiltrated with immune cells, particularly regulatory T (Treg) cells. In one embodiment, damage to cells is elicited by ADCC activity, CDC activity, or ADCP activity. In one embodiment, cells expressing CTLA-4 on their cell surface are damaged. In a further embodiment, cells to be damaged are Treg cells. In certain embodiments, Treg cells which have infiltrated into tumor tissues are damaged. In one embodiment, immunity is activated by damage to Treg cells (immunosuppression by Treg cells is cancelled). In further embodiments, immunity (particularly antitumor immunity) in tumor tissues is activated. In some embodiments, the activation of immunity is T cell activation.

In further aspects, the degree of effect as a medicament produced by the anti-CTLA-4 antibody of the present invention varies according to the tissue in an individual. In certain embodiments, that degree of effect changes depending on the concentration of an adenosine-containing compound in the tissue. In further embodiments, the effect increases in a tissue with a high concentration of an adenosine-containing compound compared to a tissue with a low concentration of the adenosine-containing compound. Tissues with a high concentration of an adenosine-containing compound include, for example, tumor tissues. Tissues with a low concentration of an adenosine-containing compound include, for example, non-tumor tissues such as normal tissues. In some embodiments, immunity is more strongly activated in a tumor tissue than in a non-tumor tissue. Such differences in response need not be observed for all doses of the anti-CTLA-4 antibodies, but need only be observed for a particular range of doses. In another embodiment, immunity is activated at a lower dose in a tumor tissue than in a non-tumor tissue. Moreover, in another embodiment, a therapeutic effect is observed at a lower dose than that at which a side effect is observed. In certain embodiments, the therapeutic effect is the expression of an antitumor effect (e.g., tumor regression and cell death induction or growth inhibition on tumor cells), and the side effect is the development of an autoimmune disease (including damage to normal tissues due to excessive immune responses).

In a further aspect, the degree of effect as a medicament produced by the anti-CTLA-4 antibody of the present invention varies according to whether or not it has binding activity to CTLA-4 that is dependent on an adenosine-containing compound (i.e., changes according to the concentration of an adenosine-containing compound). In some embodiments, the anti-CTLA-4 antibodies of the present invention are antibodies whose binding activity to CTLA-4 increases as the concentration of an adenosine-containing compound rises. In some embodiments, a control anti-CTLA-4 antibody is an antibody which does not have CTLA-4-binding activity dependent on the concentration of an adenosine-containing compound. In certain embodiments, the antibody which does not have CTLA-4-binding activity dependent on the concentration of an adenosine-containing compound means an antibody in which the difference in CTLA-4-binding activity between in the presence and in the absence of the compound is, for example, less than twice, less than 1.8 times, less than 1.5 times, less than 1.3 times, less than 1.2 times, or less than 1.1 times. It is desirable that the anti-CTLA-4 antibody of the present invention and the control anti-CTLA-4 antibody have CTLA-4-binding activity substantially equivalent to each other in the presence of a sufficient amount of an adenosine-containing compound.

In certain aspects, the anti-CTLA-4 antibody of the present invention and the control anti-CTLA-4 antibody differ in the effect as a medicament produced by each antibody. In certain embodiments, they differ in the effect as a medicament in a tissue with a low concentration of an adenosine-containing compound. Tissues with a low concentration of an adenosine-containing compound include, for example, non-tumor tissues such as normal tissues. The anti-CTLA-4 antibodies can also be provided as a pharmaceutical formulation comprising the antibody. In some embodiments, in a tissue with a low concentration of an adenosine-containing compound, the anti-CTLA-4 antibody of the present invention shows a low level of activation of immunity compared to the control anti-CTLA-4 antibody. In some embodiments, in a tissue with a low concentration of an adenosine-containing compound, the doses of the anti-CTLA-4 antibody of the present invention required to activate immunity are high compared to the control anti-CTLA-4 antibody. In some embodiments, in a tissue with a low concentration of an adenosine-containing compound, the anti-CTLA-4 antibody of the present invention has a low level of side effect compared to the control anti-CTLA-4 antibody. In some embodiments, in a tissue with a low concentration of an adenosine-containing compound, the doses of the anti-CTLA-4 antibody of the present invention at which a side effect is observed are high compared to the control anti-CTLA-4 antibody. Such differences in response need not be observed in all tissues (e.g., all tissues with a low concentration of an adenosine-containing compound), but need only be observed in some tissues. In certain embodiments, the side effect is an autoimmune disease (including damage to normal tissues due to excessive immune responses).

In certain aspects, the anti-CTLA-4 antibody of the present invention and the control anti-CTLA-4 antibody each produce a substantially equivalent effect as a medicament. In certain embodiments, they produce a substantially equivalent effect as a medicament in a tissue with a high concentration of an adenosine-containing compound. Tissues with a high concentration of an adenosine-containing compound include, for example, tumor tissues. The anti-CTLA-4 antibodies can also be provided as pharmaceutical formulations comprising the antibody. In some embodiments, in a tissue with a high concentration of an adenosine-containing compound, the anti-CTLA-4 antibody of the present invention and the control anti-CTLA-4 antibody show a substantially equivalent level of activation of immunity. In some embodiments, in a tissue with a high concentration of an adenosine-containing compound, the anti-CTLA-4 antibody of the present invention and the control anti-CTLA-4 antibody are substantially equivalent in the dose required to activate immunity. In some embodiments, in a tissue with a high concentration of an adenosine-containing compound, the anti-CTLA-4 antibody of the present invention and the control anti-CTLA-4 antibody have a substantially equivalent level of therapeutic effect. In some embodiments, in a tissue with a high concentration of an adenosine-containing compound, the anti-CTLA-4 antibody of the present invention and the control anti-CTLA-4 antibody are substantially equivalent in the dose at which a therapeutic effect is observed. In certain embodiments, the therapeutic effect is the expression of an antitumor effect (e.g., tumor regression and cell death induction or growth inhibition on tumor cells).

In some embodiments, the tumor can be arbitrarily selected from the group consisting of carcinoma, lymphoma, blastoma, sarcoma, and leukemia. In further embodiments, the tumor can be arbitrarily selected from the group consisting of lung cancer, small cell lung cancer, non-small cell lung cancer, pulmonary adenocarcinoma, squamous cell carcinoma of the lung, large intestine cancer, rectal cancer, colon cancer, breast cancer, liver cancer, gastric cancer, pancreatic cancer, renal cancer, prostate cancer, ovarian cancer, thyroid cancer, cholangiocarcinoma, peritoneal cancer, mesothelioma, squamous cell carcinoma, cervical cancer, endometrial cancer, bladder cancer, esophageal cancer, head and neck cancer, nasopharyngeal cancer, salivary gland tumor, thymoma, skin cancer, basal cell tumor, melanoma, malignant melanoma, anal cancer, penile cancer, testicular cancer, Wilms' tumor, acute myeloid leukemia (including acute myeloleukemia, acute myeloblastic leukemia, acute promyelocytic leukemia, acute myelomonocytic leukemia, and acute monocytic leukemia), chronic myelogenous leukemia, acute lymphoblastic leukemia, chronic lymphatic leukemia, Hodgkin's lymphoma, non-Hodgkin's lymphoma (including Burkitt's lymphoma, chronic lymphocytic leukemia, mycosis fungoides, mantle cell lymphoma, follicular lymphoma, diffuse large-cell lymphoma, marginal zone lymphoma, pilocytic leukemia plasmacytoma, peripheral T-cell lymphoma, and adult T cell leukemia/lymphoma), Langerhans cell histiocytosis, multiple myeloma, myelodysplastic syndrome, brain tumor (including glioma, astroglioma, glioblastoma, meningioma, and ependymoma), neuroblastoma, retinoblastoma, osteosarcoma, Kaposi's sarcoma, Ewing's sarcoma, angiosarcoma, and hemangiopericytoma. In particular embodiments, the tumor can be arbitrarily selected from the group consisting of lung cancer, large intestine cancer, colon cancer, breast cancer, liver cancer, pancreatic cancer, renal cancer, bladder cancer, head and neck cancer, and melanoma.

In a further aspect, the present invention provides for the use of an anti-CTLA-4 antibody in the manufacture or preparation of a medicament. In one embodiment, the medicament is for treatment of tumor. In a further embodiment, the medicament is for use in a method of treating tumor comprising administering to an individual having tumor an effective amount of the medicament. In one such embodiment, the method further comprises administering to the individual an effective amount of at least one additional therapeutic agent, e.g., as described below. In a further embodiment, the medicament is for damaging cells. In a further embodiment, the medicament is for use in a method of damaging cells in an individual comprising administering to the individual an effective amount of the medicament to damage cells. In a further embodiment, the medicament is for activating immunity. In a further embodiment, the medicament is for use in a method of activating immunity in an individual comprising administering to the individual an effective amount of the medicament to activate immunity. An "individual" according to any of the above embodiments may be a human.

In a further aspect, the present invention provides a method for treating a tumor. In one embodiment, the method comprises administering to an individual having such tumor an effective amount of an anti-CTLA-4 antibody. In one such embodiment, the method further comprises administering to the individual an effective amount of at least one additional therapeutic agent, as described below. An "individual" according to any of the above embodiments may be a human.

In a further aspect, the present invention provides a method for damaging cells in an individual. In one embodiment, the method comprises administering to the individual an effective amount of an anti-CTLA-4 antibody to damage cells. In a further aspect, the present invention provides a method for activating immunity in an individual. In one embodiment, the method comprises administering to the individual an effective amount of an anti-CTLA-4 antibody to activate immunity. In one embodiment, an "individual" is a human.

In a further aspect, the present invention provides pharmaceutical formulations (pharmaceutical compositions) comprising any of the anti-CTLA-4 antibodies provided herein, e.g., for use in any of the above therapeutic methods. In one embodiment, a pharmaceutical formulation (pharmaceutical composition) comprises any of the anti-CTLA-4 antibodies provided herein and a pharmaceutically acceptable carrier. In one embodiment, the present invention provides a pharmaceutical formulation (pharmaceutical composition) for use in treating tumor. In one embodiment, the present invention provides a pharmaceutical formulation (pharmaceutical composition) for use in damaging cells. In one embodiment, the present invention provides a pharmaceutical formulation (pharmaceutical composition) for use in activating immunity. In another embodiment, a pharmaceutical formulation (pharmaceutical composition) comprises any of the anti-CTLA-4 antibodies provided herein and at least one additional therapeutic agent, e.g., as described below.

In a further aspect, the present invention provides methods for preparing a medicament or a pharmaceutical formulation (e.g., for use in any of the above-mentioned therapeutic methods), comprising mixing any of the anti-CTLA-4 antibodies provided herein with a pharmaceutically acceptable carrier. In one embodiment, the method for preparing a medicament or a pharmaceutical formulation further comprises adding at least one additional therapeutic agent to the medicament or pharmaceutical formulation.

Antibodies of the present invention can be used either alone or in combination with other agents in a therapy. For instance, an antibody of the present invention may be co-administered with at least one additional therapeutic agent. In certain embodiments, an additional therapeutic agent is an immune checkpoint inhibitor, EGFR inhibitor, HER2 inhibitor, or chemotherapeutic agent. Immune checkpoint inhibitor may include, for example, an anti-CTLA-4 inhibitor, anti-PD-1 inhibitor, anti-PD-L1 inhibitor, anti-PD-L2 inhibitor, anti-TIM-3 inhibitor, anti-LAG-3 inhibitor, anti-TIGIT inhibitor, anti-BTLA inhibitor, and anti-VISTA inhibitor. Anti-CTLA-4 inhibitor may include, for example, ipilimumab and tremelimumab. Anti-PD-1 inhibitor may include, for example, nivolumab and pembrolizumab. Anti-PD-L1 inhibitor may include, for example, atezolizumab, durvalumab, and avelumab. Anti-PD-L2 inhibitor may include, for example, anti-PD-L2 inhibitory antibody. Anti-TIM-3 inhibitor may include, for example, anti-TIM-3 inhibitory antibody. Anti-LAG-3 inhibitor may include, for example, anti-LAG-3 inhibitory antibody. Anti-TIGIT inhibitor may include, for example, anti-TIGIT inhibitory antibody. Anti-BTLA inhibitor may include, for example, anti-BTLA inhibitory antibody. Anti-VISTA inhibitor may include, for example, anti-VISTA inhibitory antibody. EGFR inhibitor may include, for example, cetuximab, panitumumab, nimotuzumab, necitumumab, and zalutumumab. HER2 inhibitor may include, for example, trastuzumab, trastuzumab emtansine, and pertuzumab.

Such combination therapies noted above encompass combined administration (where two or more therapeutic agents are included in the same or separate formulations), and separate administration, in which case, administration of the antibody of the present invention can occur prior to, simultaneously, and/or following, administration of the additional therapeutic agent or agents. In one embodiment, administration of the anti-CTLA-4 antibody and administration of an additional therapeutic agent occur within about one month, or within about one, two or three weeks, or within about one, two, three, four, five, or six days, of each.

Antibodies of the present invention can also be used in combination with radiation therapy.

An antibody of the present invention (and any additional therapeutic agent) can be administered by any suitable means, including parenteral, intrapulmonary, and intranasal, and, if desired for local treatment, intralesional administration. Parenteral infusions include intramuscular, intravenous, intraarterial, intraperitoneal, or subcutaneous administration. Dosing can be by any suitable route, e.g., by injections, such as intravenous or subcutaneous injections, depending in part on whether the administration is brief or chronic. Various dosing schedules including but not limited to single or multiple administrations over various timepoints, bolus administration, and pulse infusion are contemplated herein.

Antibodies of the present invention would be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners. The antibody need not be, but is optionally formulated with one or more agents currently used to prevent or treat the disorder in question. The effective amount of such other agents depends on the amount of antibody present in the formulation, the type of disorder or treatment, and other factors discussed above. These are generally used in the same dosages and with administration routes as described herein, or about from 1 to 99% of the dosages described herein, or in any dosage and by any route that is empirically/clinically determined to be appropriate.

For the prevention or treatment of disease, the appropriate dosage of an antibody of the present invention (when used alone or in combination with one or more other additional therapeutic agents) will depend on the type of disease to be treated, the type of antibody, the severity and course of the disease, whether the antibody is administered for preventive or therapeutic purposes, previous therapy, the patient's clinical history and response to the antibody, and the discretion of the attending physician. The antibody is suitably administered to the patient at one time or over a series of treatments. Depending on the type and severity of the disease, about 1 µg/kg to 15 mg/kg (e.g., 0.1 mg/kg-10 mg/kg) of antibody can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. One exemplary dosage of the antibody would be in the range from about 0.05 mg/kg to about 10 mg/kg. Thus, one or more doses of about 0.5 mg/kg, 2.0 mg/kg, 4.0 mg/kg or 10 mg/kg (or any combination thereof) may be administered to the patient. Such doses may be administered intermittently, e.g., every week or every three weeks (e.g., such that the patient receives from about two to about twenty, or e.g., about six doses of the antibody). An initial higher loading dose, followed by one or more lower doses may be administered. The progress of this therapy is easily monitored by conventional techniques and assays.

It is understood that any of the above formulations or therapeutic methods may be carried out using an immunoconjugate of the present invention in place of or in addition to an anti-CTLA-4 antibody.

The anti-CTLA-4 antibody herein may be administered by a method of administering or integrating a nucleic acid encoding the anti-CTLA-4 antibody in vivo using a vector or such and expressing the anti-CLLA-4 antibody directly in vivo, or may be administered without using a vector. Examples of the vector include a virus vector and a plasmid vector, and further include an adenovirus vector. The nucleic acid encoding the anti-CTLA-4 antibody may be administered directly in vivo, or a cell introduced with the nucleic acid encoding the anti-CTLA-4 antibody may be administered in vivo. For example, the anti-CTLA-4 antibody can be administered by a method of administering an mRNA encoding the anti-CTLA-4 antibody which is chemically modified to enhance the stability of the mRNA in vivo, directly to a human to express the anti-CTLA-4 antibody in vivo (see EP2101823B and WO2013/120629). B cells introduced with the nucleic acid encoding the anti-CTLA-4 antibody may be administered (Sci Immunol. (2019) 4 (35), eaax0644). Bacteria introduced with the nucleic acid encoding the anti-CTLA-4 antibody may be administered (Nature Reviews Cancer (2018) 18, 727-743).

Non-limiting examples of technologies that can be combined with the anti-CTLA-4 antibody herein include production of T cells secreting a T cell redirecting antibody utilizing the anti-CTLA-4 antibody (Trends Immunol. (2019) 40(3) 243-257). One non-limiting production method is a method of introducing a nucleic acid(s) that encodes a bispecific antibody comprising a binding domain against any of subunits constituting a T cell receptor (TCR) complex on T cells, in particular, a binding domain against a CD3 epsilon chain among CD3, and an antigen binding domain of the anti-CTLA-4 antibody, into effector cells such as T cells by gene modification techniques.

H. Articles of Manufacture

In another aspect of the present invention, an article of manufacture containing materials useful for the treatment, prevention and/or diagnosis of the disorders described above is provided. The article of manufacture comprises a container and a label on or a package insert associated with the container. Suitable containers include, for example, bottles, vials, syringes, IV (intravenous) solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper pierceable by a hypodermic injection needle). At least one active ingredient in the composition is an antibody of the present invention. The label or package insert indicates that the composition is used for treating the condition of choice. Moreover, the article of manufacture may comprise (a) a first container with a composition contained therein, wherein the composition comprises an antibody of the present invention; and (b) a second container with a composition contained therein, wherein the composition comprises a further cytotoxic or otherwise therapeutic agent. The article of manufacture in this embodiment of the present invention may further comprise a package insert indicating that the compositions can be used to treat a particular condition. Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

It is understood that any of the above articles of manufacture may include an immunoconjugate of the present invention in place of or in addition to an anti-CTLA-4 antibody.

In one aspect, the present invention provides isolated polypeptides comprising a variant Fc region. In some aspects, the polypeptides are antibodies. In some aspects, the polypeptides are Fc fusion proteins. In certain embodiments, the variant Fc regions comprise at least one amino acid residue alteration (e.g., substitution) compared to the corresponding sequence in the Fc region of a native sequence or a reference variant sequence (herein may be collectively referred to as the "parent" Fc region). The Fc region of a native sequence is usually composed as a homodimer consisting of two identical polypeptide chains. The amino acid alterations in the variant Fc regions in the present invention may be introduced into either one of the two polypeptide chains of the parent Fc region, or into both of the two polypeptide chains.

In some aspects, the present invention provides variant Fc regions whose function has been modified compared to the parent Fc region. In certain aspects, the variant Fc regions in the present invention have enhanced binding activity to Fcγ receptor compared to the parent Fc region. In certain embodiments, the variant Fc regions in the present invention have enhanced binding activity to at least one Fcγ receptor selected from the group consisting of FcγRIa, FcγRIIa, FcγRIIb, and FcγRIIIa, compared to the parent Fc region. In some embodiments, the variant Fc regions in the present invention have enhanced binding activity to FcγRIIa. In some embodiments, the variant Fc regions in the present invention have enhanced binding activity to FcγRIIIa. In further embodiments, the variant Fc regions in the present invention have enhanced binding activity to FcγRIIa and FcγRIIIa. In another aspect, the variant Fc regions in the present invention have enhanced ADCC activity, CDC activity, or ADCP activity compared to the parent Fc region.

In some embodiments, the variant Fc regions in the present invention comprise at least one amino acid alteration at at least one position selected from the group consisting of positions 234, 235, 236, 298, 330, 332, and 334 according to EU numbering. Alternatively, amino acid alterations such as those described in WO 2013/002362 and WO 2014/104165 can be similarly used in the present invention.

In certain embodiments, the binding activity of the parent Fc region and the variant Fc regions can be represented by a KD (dissociation constant) value. In one embodiment, the value of the ratio of [KD value of the parent Fc region for FcγRIIa]/[KD value of a variant Fc region for FcγRIIa] is, for example, 1.5 or more, 2 or more, 3 or more, 4 or more, 5 or more, 6 or more, 7 or more, 8 or more, 9 or more, 10 or more, 15 or more, 20 or more, 25 or more, 30 or more, 40 or more, or 50 or more. In further embodiments, FcγRIIa may be FcγRIIa R or FcγRIIa H, or may also be both. Therefore, KD value of an Fc region for FcγRIIa may be a KD value of the Fc region for FcγRIIa R, a KD value of the Fc region for FcγRIIa H, or the sum or average of both. In one embodiment, the value of the ratio of [binding activity of the parent Fc region to FcγRIIIa]/[binding activity of a variant Fc region to FcγRIIIa] is, for example, 2 or more, 3 or more, 5 or more, 10 or more, 20 or more, 30 or more, 50 or more, 100 or more, 200 or more, 300 or more, 500 or more, $1\times10^3$ or more, $2\times10^3$ or more, $3\times10^3$ or more, or $5\times10^3$ or more. In further embodiments, FcγRIIIa may be FcγRIIIa F or FcγRIIIa V, or may also be both. Therefore, the KD value of an Fc region for FcγRIIIa may be a KD value of the Fc region for FcγRIIIa F, a KD value of the Fc region for FcγRIIIa V, or the sum or average of both.

In one embodiment, the KD values of the variant Fc regions for FcγRIIa are, for example, $1.0\times10^{-6}$ M or less, $5.0\times10^{-7}$ M or less, $3.0\times10^{-7}$ M or less, $2.0\times10^{-7}$ M or less, $1.0\times10^{-7}$ M or less, $5.0\times10^{-8}$ M or less, $3.0\times10^{-8}$ M or less, $2.0\times10^{-8}$ M or less, $1.0\times10^{-8}$ M or less, $5.0\times10^{-9}$ M or less, $3.0\times10^{-9}$ M or less, $2.0\times10^{-9}$ M or less, or $1.0\times10^{-9}$ M or less. In further embodiments, FcγRIIa may be FcγRIIa R or FcγRIIa H, or may also be both. In one embodiment, the KD values of the variant Fc regions for FcγRIIIa are, for example, $1.0\times10^{-6}$ M or less, $5.0\times10^{-7}$ M or less, $3.0\times10^{-7}$ M or less, $2.0\times10^{-7}$ M or less, $1.0\times10^{-7}$ M or less, $5.0\times10^{-8}$ M or less, $3.0\times10^{-8}$ M or less, $2.0\times10^{-8}$ M or less, $1.0\times10^{-8}$ M or less, $5.0\times10^{-9}$ M or less, $3.0\times10^{-9}$ M or less, $2.0\times10^{-9}$ M or less, $1.0\times10^{-9}$ M or less, $5.0\times10^{-10}$ M or less, $3.0\times10^{-10}$ M or less, $2.0\times10^{-10}$ M or less, or $1.0\times10^{-10}$ M or less. In further embodiments, FcγRIIIa may be FcγRIIIa F or FcγRIIIa V, or may also be both. In another embodiment, the binding activity of the parent and variant Fc regions may be represented by a kd (dissociation rate constant) value instead of a KD value.

In another embodiment, the binding activity of the parent and variant Fc regions may be represented by the binding amount to an Fcγ receptor per unit amount of the Fc region. For example, in a surface plasmon resonance assay, the binding amount of an Fc region immobilized onto a sensor chip and the binding amount of an Fcγ receptor further bound thereto are each measured as a resonance unit (RU). The value obtained by dividing the binding amount of the Fcγ receptor by the binding amount of the Fc region can be defined as the binding amount to the Fcγ receptor per unit amount of the Fc region. Specific methods for measuring and calculating such binding amounts are described in Examples below. In some embodiments, the value of the ratio of [binding amount of a variant Fc region to FcγRIIa]/[binding amount of the parent Fc region to FcγRIIa] is, for example, 1.5 or more, 2 or more, 3 or more, 4 or more, 5 or more, 6 or more, 7 or more, 8 or more, 9 or more, 10 or more, 15 or more, 20 or more, 25 or more, 30 or more, or 40 or more, or 50 or more. In some embodiments, the value of the ratio of [binding amount of a variant Fc region to FcγRIIIa]/[binding amount of the parent Fc region to FcγRIIIa] is, for example, 2 or more, 3 or more, 5 or more, 10 or more, 20 or more, 30 or more, 50 or more, 100 or more, 200 or more, 300 or more, 500 or more, $1\times10^3$ or more, $2\times10^3$ or more, $3\times10^3$ or more, or $5\times10^3$ or more.

In certain embodiments, the KD values, kd values, values of binding amount and such described herein are measured or calculated by performing a surface plasmon resonance assay at 25° C. or 37° C. (see, for example, Reference Example 8 herein).

In certain aspects, the variant Fc region in the present invention has improved selectivity between activating and inhibitory Fcγ receptors compared to the parent Fc region. In other words, the binding activity of the variant Fc region in the present invention to an activating Fcγ receptor is greatly enhanced than that to an inhibitory Fcγ receptor, compared to the parent Fc region. In certain embodiments, the activating Fcγ receptor is at least one Fcγ receptor selected from the group consisting of FcγRIa, FcγRIIa R, FcγRIIa H, FcγRIIIa F, and FcγRIIIa V, and the inhibitory Fcγ receptor is FcγRIIb. In some embodiments, the variant Fc regions in the present invention have improved selectivity between FcγRIIa and FcγRIIb. In some embodiments, the variant Fc region in the present invention has improved selectivity between FcγRIIIa and FcγRIIb. In further embodiments, the variant Fc regions in the present invention have improved selectivity between FcγRIIIa and FcγRIIb and between FcγRIIIa and FcγRIIb.

In some embodiments, the variant Fc regions in the present invention comprise at least one amino acid alteration at at least one position selected from the group consisting of positions 236, 239, 268, 270, and 326 according to EU numbering. Alternatively, the amino acid alterations described in WO 2013/002362 and WO 2014/104165 can be similarly used in the present invention.

In certain embodiments, the binding activity of the parent and variant Fc regions can be represented by a KD (dissociation constant) value. The embodiments of the binding activity to FcγRIIa and FcγRIIIa are as described above. In one embodiment, the value of the ratio of [KD value of the parent Fc region for FcγRIIb]/[KD value of a variant Fc region for FcγRIIb] is, for example, 10 or less, 5 or less, 3 or less, 2 or less, 1 or less, 0.5 or less, 0.3 or less, 0.2 or less, or 0.1 or less. In another embodiment, the binding activity of the parent and variant Fc regions may be represented by a kd (dissociation rate constant) value instead of a KD value.

In another embodiment, the binding activity of the parent and variant Fc regions may be represented by the above-mentioned binding amount to an Fcγ receptor per unit amount of the Fc region. In some embodiments, the value of the ratio of [binding amount of a variant Fc region to FcγRIIb]/[binding amount of the parent Fc region to FcγRIIb] is, for example, 10 or less, 5 or less, 3 or less, 2 or less, 1 or less, 0.5 or less, 0.3 or less, 0.2 or less, or 0.1 or less. In some embodiments, the binding amount of the variant Fc region to FcγRIIb is, for example, 0.5 or less, 0.3 or less, 0.2 or less, 0.1 or less, 0.05 or less, 0.03 or less, 0.02 or less, 0.01 or less, 0.005 or less, 0.003 or less, 0.002 or less, or 0.001 or less.

In a certain embodiment, the improvement of selectivity between an activating Fcγ receptor and an inhibitory Fcγ receptor is selective enhancement of binding activity to an activating Fcγ receptor as compared to binding activity to an inhibitory Fcγ receptor, or in other words, an increase in the ratio of binding activity to an activating Fcγ receptor to binding activity to an inhibitory Fcγ receptor (A/I ratio). This ratio (A/I ratio) is an index for exertion of excellent effector functions. Polypeptides with a high A/I ratio can be evaluated as having excellent effector functions. The binding activity of a parent Fc region and a variant Fc region to an Fcγ receptor can be represented by a KD value, a kd value, or the binding amount of the Fc region to the Fcγ receptor per unit amount. The A/I ratio can be expressed using KD values, kd values, or binding amounts as follows: [KD value for an inhibitory Fcγ receptor]/[KD value for an activating Fcγ receptor], [kd value for an inhibitory Fcγ receptor]/[kd value for an activating Fcγ receptor], or [binding amount to an activating Fcγ receptor]/[binding amount to an inhibitory Fcγ receptor].

In one embodiment, the A/I ratio of the variant Fc region of the present invention is increased 1.1 times or more, 1.2 times or more, 1.3 times or more, 1.4 times or more, 1.5 times or more, 1.6 times or more, 1.7 times or more, 1.8 times or more, 1.9 times or more, 2 times or more, 3 times or more, 4 times or more, 5 times or more, 6 times or more, 7 times or more, 8 times or more, 9 times or more, 10 times or more, 20 times or more, 30 times or more, 40 times or more, 50 times or more, 60 times or more, 70 times or more, 80 times or more, 90 times or more, 100 times or more, 200 times or more, 300 times or more, 400 times or more, 500 times or more, 600 times or more, 700 times or more, 800 times or more, 900 times or more, 1000 times or more, 2000 times or more, 3000 times or more, 4000 times or more, 5000 times or more, 6000 times or more, 7000 times or more, 8000 times or more, 9000 times or more, or 10000 times or more as compared to that of the parent Fc region. In one embodiment, the A/I ratio of the variant Fc region of the present invention has a value of 10 or higher, 20 or higher, 30 or higher, 40 or higher, 50 or higher, 60 or higher, 70 or higher, 80 or higher, 90 or higher, 100 or higher, 200 or higher, 300 or higher, 400 or higher, 500 or higher, 600 or higher, 700 or higher, 800 or higher, 900 or higher, 1000 or higher, 2000 or higher, 3000 or higher, 4000 or higher, 5000 or higher, 6000 or higher, 7000 or higher, 8000 or higher, 9000 or higher, 10000 or higher, 11000 or higher, 12000 or higher, 13000 or higher, 14000 or higher, or 15000 or higher. In one embodiment, the A/I ratio is a ratio of binding activity to FcγRIa to binding activity to FcγRIIb, a ratio of binding activity to FcγRIIa to binding activity to FcγRIIb, a ratio of binding activity to FcγRIIIa to binding activity to FcγRIIb, or a ratio of [the sum or average of two or three of binding activity to FcγRIa, binding activity to FcγRIIa, and binding activity to FcγRIIIa] to binding activity to FcγRIIb. In a certain embodiment, FcγRIIa is FcγRIIa R, FcγRIIa H, or both. Thus, the binding activity to FcγRIIa is binding activity to FcγRIIa R, binding activity to FcγRIIa H, or the sum or average of both. In a certain embodiment, FcγRIIIa is FcγRIIIa F, FcγRIIIa V, or both. Thus, the binding activity to FcγRIIIa is binding activity to FcγRIIIa F, binding activity to FcγRIIIa V, or the sum or average of both.

In some embodiments, the variant Fc region of the present invention comprises amino acid alterations at the following positions:
(i) positions 234, 235, 236, 239, 268, 270, and 298 according to EU numbering in the first polypeptide of the parent Fc region; and
(ii) positions 270, 298, 326, and 334 according to EU numbering in the second polypeptide of the parent Fc region.

In a certain embodiment, the variant Fc region of the present invention further comprises an amino acid alteration at position 326 according to EU numbering in the first polypeptide of the parent Fc region. In a certain embodiment, the variant Fc region of the present invention further comprises an amino acid alteration at position 236 according to EU numbering in the second polypeptide of the parent Fc region. In a certain embodiment, the variant Fc region of the present invention further comprises an amino acid alteration at position 332 according to EU numbering in the first polypeptide of the parent Fc region. In a certain embodiment, the variant Fc region of the present invention further comprises an amino acid alteration at position 330 according to EU numbering in the first polypeptide of the parent Fc region. In a certain embodiment, the variant Fc region of the present invention further comprises an amino acid alteration at position 332 according to EU numbering in the second polypeptide of the parent Fc region. In a certain embodiment, the variant Fc region of the present invention further comprises an amino acid alteration at position 330 according to EU numbering in the second polypeptide of the parent Fc region. Alternatively, the amino acid alterations described in International Publications WO2013/002362 and WO2014/104165 may also be similarly used in the present invention.

In some embodiments, the variant Fc region of the present invention comprises amino acid alterations at the following positions:
(i) positions 234, 235, 236, 239, 268, 270, 298, and 330 according to EU numbering in the first polypeptide of the parent Fc region; and
(ii) positions 270, 298, 326, 330, and 334 according to EU numbering in the second polypeptide of the parent Fc region.

In a specific embodiment, the variant Fc region of the present invention further comprises an amino acid alteration at position 326 according to EU numbering in the first polypeptide of the parent Fc region. In a specific embodiment, the variant Fc region of the present invention further comprises an amino acid alteration at position 236 according to EU numbering in the second polypeptide of the parent Fc region. In a specific embodiment, the variant Fc region of the present invention further comprises an amino acid alteration at position 332 according to EU numbering in the first polypeptide of the parent Fc region. In a specific embodiment, the variant Fc region of the present invention further comprises an amino acid alteration at position 332 according to EU numbering in the second polypeptide of the parent Fc region. In a specific embodiment, the amino acid alterations described in WO 2013/002362 and WO 2014/104165 are also used in the present invention similarly.

In certain aspects, the variant Fc regions in the present invention have improved stability compared to the parent Fc region. In certain embodiments, the stability is thermodynamic stability. The thermodynamic stability of a polypeptide can be judged, for example, by using the Tm value as an indicator. Tm values can be measured using techniques known to those skilled in the art, such as circular dichroism (CD), differential scanning calorimeter (DSC), and differential scanning fluorimetry (DSF). In one embodiment, in the variant Fc region in the present invention, the Tm value of the CH2 region is increased by 0.1 degrees or more, 0.2 degrees or more, 0.3 degrees or more, 0.4 degrees or more, 0.5 degrees or more, 1 degree or more, 2 degrees or more, 3 degrees or more, 4 degrees or more, 5 degrees or more, or 10 degrees or more, compared to that in the parent Fc region.

In some embodiments, the variant Fc regions in the present invention comprise at least one amino acid alteration at at least one position selected from the group consisting of positions 250 and 307 according to EU numbering in the first polypeptide and/or the second polypeptide of the parent Fc region. Alternatively, the amino acid alterations described in WO 2013/118858 can be similarly used in the present invention.

In certain aspects, the variant Fc region in the present invention is composed of two polypeptide chains with different sequences from each other. In a further aspect, in the variant Fc region in the present invention, heterodimerization between a first polypeptide and a second polypeptide has been promoted. When a heterodimeric protein is produced using a recombination method, it is preferable that peptide chains different from each other preferentially associate to form a heterodimer, rather than that identical polypeptide chains associate to form a homodimer. Whether heterodimerization in a variant Fc region is promoted or not can be judged, for example, by separating homodimers and heterodimers from the produced variant Fc regions by a technique such as chromatography, and by determining the ratio of each component.

In some embodiments, the variant Fc regions in the present invention comprise at least one amino acid alteration at at least one position selected from the group consisting of positions 349, 356, 366, 368, 407, and 439 according to EU numbering in the first polypeptide and/or the second polypeptide of the parent Fc region. Alternatively, the amino acid alterations described in WO 2006/106905 and WO 1996/027011 can be similarly used in the present invention.

In certain aspects, the variant Fc region in the present invention has enhanced binding activity to FcRn under acidic pH. In some embodiments, the acidic pH means pH 4.0 to 6.5. In further embodiments, the acidic pH is at least one selected from the group consisting of pH 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, and 6.5. In certain embodiments, the acidic pH is pH 5.8.

In some embodiments, the variant Fc regions in the present invention comprise at least one amino acid alteration at at least one position selected from the group consisting of positions 428, 434, 436, 438, and 440 according to EU numbering in the first polypeptide and/or the second polypeptide of the parent Fc region. Alternatively, the amino acid alterations described in WO 2016/125495 can be similarly used in the present invention.

In one aspect, the variant Fc region in the present invention comprises at least one amino acid alteration at at least one position selected from the group consisting of positions 234, 235, 236, 239, 250, 268, 270, 298, 307, 326, 330, 332, 334, 349, 356, 366, 368, 407, 428, 434, 436, 438, 439, and 440 according to EU numbering.

In one embodiment, the variant Fc region in the present invention comprises amino acid alterations at positions 234, 235, 236, 239, 268, 270, 298, 326, and 334 according to EU numbering. In certain embodiments, the variant Fc region in the present invention comprises amino acid alterations at (i) positions 234, 235, 236, 239, 268, 270, and 298 according to EU numbering in the first polypeptide of the parent Fc region, and (ii) positions 270, 298, 326, and 334 according to EU numbering in the second polypeptide of the parent Fc region. In another certain embodiment, the variant Fc region of the present invention comprises amino acid alterations at (i) positions 234, 235, 236, 239, 268, 270, 298, and 326 according to EU numbering in the first polypeptide of the parent Fc region, and (ii) positions 236, 270, 298, 326, and 334 according to EU numbering in the second polypeptide of the parent Fc region.

In one embodiment, the variant Fc region of the present invention comprises amino acid alterations at positions 234, 235, 236, 239, 268, 270, 298, 326, 330, and 334 according to EU numbering. In a specific embodiment, the variant Fc region of the present invention comprises amino acid alterations (i) at positions 234, 235, 236, 239, 268, 270, 298, and 330 according to EU numbering in the first polypeptide of the parent Fc region, and (ii) at positions 270, 298, 326, 330, and 334 according to EU numbering in the second polypeptide of the parent Fc region.

In one embodiment, the variant Fc region of the present invention comprises amino acid alterations at positions 234, 235, 236, 239, 250, 268, 270, 298, 307, 326, and 334 according to EU numbering. In a certain embodiment, the variant Fc region of the present invention comprises amino acid alterations at (i) positions 234, 235, 236, 239, 250, 268, 270, 298, and 307 according to EU numbering in the first polypeptide of the parent Fc region, and (ii) positions 250, 270, 298, 307, 326, and 334 according to EU numbering in the second polypeptide of the parent Fc region. In another certain embodiment, the variant Fc region of the present invention comprises amino acid alterations at (i) positions 234, 235, 236, 239, 250, 268, 270, 298, 307, and 326 according to EU numbering in the first polypeptide of the parent Fc region, and (ii) positions 236, 250, 270, 298, 307, 326, and 334 according to EU numbering in the second polypeptide of the parent Fc region.

In one embodiment, the variant Fc region of the present invention comprises amino acid alterations at positions 234, 235, 236, 239, 268, 270, 298, 326, 330, 332, and 334 according to EU numbering. In a certain embodiment, the variant Fc region of the present invention comprises amino acid alterations at (i) positions 234, 235, 236, 239, 268, 270, 298, 330, and 332 according to EU numbering in the first polypeptide of the parent Fc region, and (ii) positions 236, 270, 298, 326, 330, 332, and 334 according to EU numbering in the second polypeptide of the parent Fc region.

In one embodiment, the variant Fc region of the present invention comprises amino acid alterations at positions 234, 235, 236, 239, 250, 268, 270, 298, 307, 326, 330, 332, and 334 according to EU numbering. In a certain embodiment, the variant Fc region of the present invention comprises amino acid alterations at (i) positions 234, 235, 236, 239, 250, 268, 270, 298, 307, 330, and 332 according to EU numbering in the first polypeptide of the parent Fc region, and (ii) positions 236, 250, 270, 298, 307, 326, 330, 332, and 334 according to EU numbering in the second polypeptide of the parent Fc region. In another certain embodiment, the variant Fc region of the present invention comprises amino acid alterations at (i) positions 234, 235, 236, 239, 250, 268, 270, 298, 307, and 326 according to EU numbering in the first polypeptide of the parent Fc region, and (ii) positions 236, 250, 270, 298, 307, 326, 330, 332, and 334 according to EU numbering in the second polypeptide of the parent Fc region.

In one embodiment, the variant Fc region of the present invention comprises amino acid alterations at positions 234, 235, 236, 239, 250, 268, 270, 298, 307, 326, 332, and 334 according to EU numbering. In a certain embodiment, the variant Fc region of the present invention comprises amino acid alterations at (i) positions 234, 235, 236, 239, 250, 268, 270, 298, 307, 326, and 332 according to EU numbering in the first polypeptide of the parent Fc region, and (ii) positions 236, 250, 270, 298, 307, 326, 332, and 334 according to EU numbering in the second polypeptide of the parent Fc region.

In one embodiment, the variant Fc region of the present invention comprises amino acid alterations at positions 234, 235, 236, 239, 250, 268, 270, 298, 307, 326, 332, and 334 according to EU numbering. In a certain embodiment, the variant Fc region of the present invention comprises amino acid alterations at (i) positions 234, 235, 236, 239, 250, 268, 270, 298, 307, and 332 according to EU numbering in the first polypeptide of the parent Fc region, and (ii) positions 250, 270, 298, 307, 326, 332, and 334 according to EU numbering in the second polypeptide of the parent Fc region.

In one embodiment, the variant Fc region of the present invention comprises amino acid alterations at positions 234, 235, 236, 239, 250, 268, 270, 298, 307, 326, 330, and 334 according to EU numbering. In a certain embodiment, the variant Fc region of the present invention comprises amino acid alterations at (i) positions 234, 235, 236, 239, 250, 268, 270, 298, 307, and 330 according to EU numbering in the first polypeptide of the parent Fc region, and (ii) positions 250, 270, 298, 307, 326, 330, and 334 according to EU numbering in the second polypeptide of the parent Fc region.

In further embodiments, the variant Fc regions in the present invention comprise at least one amino acid alteration selected from the group consisting of: (i) Tyr or Phe at position 234, Gln or Tyr at position 235, Trp at position 236, Met at position 239, Val at position 250, Asp at position 268, Glu at position 270, Ala at position 298, Pro at position 307, Asp at position 326, Met at position 330, Glu at position 332, according to EU numbering, in the first polypeptide of the parent Fc region; and (ii) Ala at position 236, Val at position 250, Glu at position 270, Ala at position 298, Pro at position 307, Asp at position 326, Met or Lys at position 330, Asp or Glu at position 332, Glu at position 334, according to EU numbering, in the second polypeptide of the parent Fc region.

In a further embodiment, the variant Fc region of the present invention further comprises any of the amino acid alterations of (a) to (f) below:
  (a) Lys at position 356 according to EU numbering in the first polypeptide of the parent Fc region, and Glu at position 439 according to EU numbering in the second polypeptide of the parent Fc region;
  (b) Glu at position 439 according to EU numbering in the first polypeptide of the parent Fc region, and Lys at position 356 according to EU numbering in the second polypeptide of the parent Fc region;
  (c) Trp at position 366 according to EU numbering in the first polypeptide of the parent Fc region, and Ser at position 366, Ala at position 368, and Val at position 407 according to EU numbering in the second polypeptide of the parent Fc region;
  (d) Ser at position 366, Ala at position 368, and Val at position 407 according to EU numbering in the first polypeptide of the parent Fc region, and Trp at position 366 according to EU numbering in the second polypeptide of the parent Fc region;
  (e) Cys at position 349 and Trp at position 366 according to EU numbering in the first polypeptide of the parent Fc region, and Cys at position 356, Ser at position 366, Ala at position 368, and Val at position 407 according to EU numbering in the second polypeptide of the parent Fc region;
  (f) Cys at position 356, Ser at position 366, Ala at position 368, and Val at position 407 according to EU numbering in the first polypeptide of the parent Fc region, and Cys at position 349 and Trp at position 366 according to EU numbering in the second polypeptide of the parent Fc region.

In further aspects, the variant Fc regions in the present invention further comprise any of the amino acid alterations (a) to (d) below in the first polypeptide and/or second polypeptide of the parent Fc region:
  (a) Ala at position 434 according to EU numbering;
  (b) Ala at position 434, Thr at position 436, Arg at position 438, and Glu at position 440, according to EU numbering;
  (c) Leu at position 428, Ala at position 434, Thr at position 436, Arg at position 438, and Glu at position 440, according to EU numbering; and
  (d) Leu at position 428, Ala at position 434, Arg at position 438, and Glu at position 440, according to EU numbering.

In a specific embodiment, a polypeptide comprising the variant Fc region of the present invention is an antibody heavy chain constant region.

In a further embodiment, the present invention provides a polypeptide comprising any one of the amino acid sequences of SEQ ID NOs: 280, 281, 283 to 305, 308, 309, and 311 to 333.

In a further embodiment, the present invention provides the heavy chain constant regions comprising the polypeptide chains of SEQ ID NOs: 308 and 309, the heavy chain constant regions comprising the polypeptide chains of SEQ ID NOs: 311 and 312, the heavy chain constant regions comprising the polypeptide chains of SEQ ID NOs: 313 and 314, the heavy chain constant regions comprising the polypeptide chains of SEQ ID NOs: 315 and 316, the heavy chain constant regions comprising the polypeptide chains of SEQ ID NOs: 317 and 318, the heavy chain constant regions comprising the polypeptide chains of SEQ ID NOs: 319 and 320, the heavy chain constant regions comprising the polypeptide chains of SEQ ID NOs: 321 and 322, the heavy chain constant regions comprising the polypeptide chains of SEQ ID NOs: 323 and 324, the heavy chain constant regions comprising the polypeptide chains of SEQ ID NOs: 325 and 326, the heavy chain constant regions comprising the polypeptide chains of SEQ ID NOs: 327 and 328, the heavy chain constant regions comprising the polypeptide chains of SEQ ID NOs: 330 and 331, the heavy chain constant regions comprising the polypeptide chains of SEQ ID NOs: 332 and 333, the heavy chain constant regions comprising the polypeptide chains of SEQ ID NOs: 358 and 359, the heavy chain constant regions comprising the polypeptide chains of SEQ ID NOs: 360 and 361, the heavy chain constant regions comprising the polypeptide chains of SEQ ID NOs: 362 and 363, the heavy chain constant regions comprising the polypeptide chains of SEQ ID NOs: 364 and 366, and the heavy chain constant regions comprising the polypeptide chains of SEQ ID NOs: 365 and 367, the heavy chain constant regions comprising the polypeptide chains of SEQ ID NOs: 376 and 377, the heavy chain constant regions comprising the polypeptide chains of SEQ ID NOs: 378 and 380, the heavy chain constant regions comprising the polypeptide chains of SEQ ID NOs: 379 and 381, and the heavy chain constant regions comprising the polypeptide chains of SEQ ID NOs: 383 and 384.

"Fcγ receptors" (herein, referred to as Fcγ receptors, FcγR or FcgR) refers to receptors that may bind to the Fc region of IgG1, IgG2, IgG3, and IgG4 monoclonal antibodies, and practically means any member of the family of proteins encoded by the Fcγ receptor genes. In humans, this family includes FcγRI (CD64) including isoforms FcγRIa, FcγRIb, and FcγRIc; FcγRII (CD32) including isoforms FcγRIIa (including allotypes H131 (type H) and R131 (type R)), FcγRIIb (including FcγRIIb-1 and FcγRIIb-2), and FcγRIIc; and FcγRIII (CD16) including isoforms FcγRIIIa (including allotypes V158 and F158), and FcγRIIIb (including allotypes FcγRIIIb-NA1 and FcγRIIIb-NA2), and any human FcγRs, FcγR isoforms or allotypes yet to be discovered, but is not limited thereto. FcγRIIb1 and FcγRIIb2 have been reported as splicing variants of human FcγRIIb. In addition, a splicing variant named FcγRIIb3 has been reported (J Exp Med, 1989, 170:1369-1385). In addition to these splicing variants, human FcγRIIb includes all splicing variants registered in NCBI, which are NP_001002273.1, NP_001002274.1, NP_001002275.1, NP_001177757.1, and NP_003992.3. Furthermore, human FcγRIIb includes every previously-reported genetic polymorphism, as well as FcγRIIb (Arthritis Rheum. 48:3242-3252 (2003); Kono et al., Hum. Mol. Genet. 14:2881-2892 (2005); and Kyogoju et al., Arthritis Rheum. 46:1242-1254 (2002)), and every genetic polymorphism that will be reported in the future.

In FcγRIIa, there are two allotypes, one where the amino acid at position 131 of FcγRIIa is histidine (type H) and the other where the amino acid at position 131 is substituted with arginine (type R) (Warmerdam, J. Exp. Med. 172:19-25 (1990)).

The FcγR includes human, mouse, rat, rabbit, and monkey-derived FcγRs but is not limited thereto, and may be derived from any organism. Mouse FcγRs include FcγRI (CD64), FcγRII (CD32), FcγRIII (CD16), and FcγRIII-2 (CD16-2), and any mouse FcγRs, or FcγR isoforms, but are not limited thereto.

The amino acid sequence of human FcγRI is set forth in SEQ ID NO: 131 (NP_000557.1); the amino acid sequence of human FcγRIIa is set forth in SEQ ID NO: 132 (AAH20823.1), SEQ ID NO: 142, SEQ ID NO: 143 or SEQ ID NO: 150; the amino acid sequence of human FcγRIIb is set forth in SEQ ID NO: 151 (AAI46679.1), SEQ ID NO: 169 or SEQ ID NO: 172; the amino acid sequence of human FcγRIIIa is set forth in SEQ ID NO: 174 (AAH33678.1), SEQ ID NO: 175, SEQ ID NO: 176 or SEQ ID NO: 177; and the amino acid sequence of human FcγRIIIb is set forth in SEQ ID NO: 178 (AAI28563.1).

Unlike Fcγ receptor belonging to the immunoglobulin superfamily, human FcRn is structurally similar to polypeptides of major histocompatibility complex (MHC) class I, exhibiting 22% to 29% sequence identity to class I MHC molecules (Ghetie et al., Immunol. Today (1997) 18 (12): 592-598). FcRn is expressed as a heterodimer consisting of soluble β chain or light chain (β2 microglobulin) complexed with transmembrane a chain or heavy chain. Like MHC, FcRn a chain comprises three extracellular domains (α1, α2, and α3) and its short cytoplasmic domain anchors the protein onto the cell surface. α1 and α2 domains interact with the FcRn-binding domain of the antibody Fc region (Raghavan et al., Immunity (1994) 1:303-315). The amino acid sequence of human FcRn is set forth in SEQ ID NO: 179 (NP_004098.1), and the amino acid sequence of β2 microglobulin is set forth in SEQ ID NO: 180 (NP_004039.1).

A "parent Fc region" as used herein refers to an Fc region prior to introduction of amino acid alteration(s) described herein. In some embodiments, the parent Fc region is an Fc region of a native sequence (or an Fc region of a native antibody). An antibody includes, for example, IgA (IgA1, IgA2), IgD, IgE, IgG (IgG1, IgG2, IgG3, IgG4), and IgM. An antibody may be derived from human or monkey (e.g., cynomolgus, rhesus macaque, marmoset, chimpanzee, or baboon). A native antibody may include naturally-occurring mutations. A plurality of allotype sequences of IgGs due to genetic polymorphism are described in "Sequences of proteins of immunological interest", NIH Publication No. 91-3242, and any of them may be used in the present invention. In particular, for human IgG1, the amino acid sequence at positions 356 to 358 (EU numbering) may be either DEL or EEM. Furthermore, for human IgG1, the amino acid at position 214 (EU numbering) may be K or R. In certain embodiments, the parent Fc region is an Fc region derived from a heavy chain constant region of human IgG1 (SEQ ID NO: 249), human IgG2 (SEQ ID NO: 250), human IgG3 (SEQ ID NO: 251), or human IgG4 (SEQ ID NO: 252). In another embodiment, the parent Fc region is an Fc region derived from a heavy chain constant region of SEQ ID NO: 82, SEQ ID NO: 158, or SEQ ID NO: 334. In further embodiments, the parent Fc region may be an Fc region produced by adding an amino acid alteration(s) other than the amino acid alteration(s) described herein to an Fc region of a native sequence (an Fc region of reference variant sequence). An Fc region of a native sequence is generally constituted as a homodimer consisting of two identical polypeptide chains.

In addition, amino acid alterations performed for other purpose(s) can be combined in a variant Fc region described herein. For example, amino acid substitutions that improve FcRn-binding activity (Hinton et al., J. Immunol. 176 (1): 346-356 (2006); Dall'Acqua et al., J. Biol. Chem. 281 (33): 23514-23524 (2006); Petkova et al., Intl. Immunol. 18 (12): 1759-1769 (2006); Zalevsky et al., Nat. Biotechnol. 28 (2): 157-159 (2010); WO 2006/019447; WO 2006/053301; and WO 2009/086320), and amino acid substitutions for improving antibody heterogeneity or stability (WO 2009/041613) may be added. Alternatively, polypeptides with the property of promoting antigen clearance, which are described in WO 2011/122011, WO 2012/132067, WO 2013/046704 or WO 2013/180201, polypeptides with the property of specific binding to a target tissue, which are described in WO 2013/180200, polypeptides with the property of repeated binding to a plurality of antigen molecules, which are described in WO 2009/125825, WO 2012/073992 or WO 2013/047752, can be combined with a variant Fc region described herein. Alternatively, with the objective of conferring binding ability to other antigens, the amino acid alterations disclosed in EP1752471 and EP1772465 may be combined in CH3 of a variant Fc region described herein. Alternatively, with the objective of increasing plasma retention, amino acid alterations that decrease the pI of the constant region (WO 2012/016227) may be combined in a variant Fc region described herein. Alternatively, with the objective of promoting uptake into cells, amino acid alterations that increase the pI of the constant region (WO 2014/145159) may be combined in a variant Fc region described herein. Alternatively, with the objective of promoting elimination of a target molecule from plasma, amino acid alterations that increase the pI of the constant region (WO 2016/125495) may be combined in a variant Fc region described herein. In one embodiment, such alteration may include, for example, substitution at at least one position selected from the group consisting of positions 311, 343, 384, 399, 400, and 413 according to EU numbering. In a further embodiment, such substitution may be a replacement of an amino acid with Lys or Arg at each position.

Methods for producing heterodimerized antibodies are not limited to these, but such antibodies may be produced by the knob-in-hole technology (see, for example, Nat. Biotechnol., (16); 677-681 (1998) and U.S. Pat. No. 5,731,168) or by engineering electrostatic steering effects (WO2006/106905, WO2009/089004A1, J. Biol. Chem., (285), 19637-19646 (2010), etc.).

For association of heterologous polypeptides comprising variant Fc regions, a technique of suppressing unintended association of homologous polypeptides comprising variant Fc regions by introducing electrostatic repulsion into the interface of the CH2 or CH3 domain of the Fc region can be applied, as described in WO 2006/106905.

Examples of amino acid residues in contact at the interface of the CH2 or CH3 domain of the Fc region include the residue at position 356 (EU numbering), the residue at position 439 (EU numbering), the residue at position 357 (EU numbering), the residue at position 370 (EU numbering), the residue at position 399 (EU numbering), and the residue at position 409 (EU numbering) in the CH3 domain.

More specifically, for example, the Fc region in which one to three pairs of amino acid residues selected from (1) to (3) shown below have the same charge can be produced: (1) amino acid residues at positions 356 and 439 (EU numbering) in the CH3 domain; (2) amino acid residues at positions 357 and 370 (EU numbering) in the CH3 domain; and (3) amino acid residues at positions 399 and 409 (EU numbering) in the CH3 domain.

Furthermore, heterologous polypeptides comprising variant Fc regions can be produced, wherein one to three pairs of amino acid residues selected from (1) to (3) indicated above have the same charge in the CH3 domain of the first Fc region, and the pairs of amino acid residues selected in the aforementioned first Fc region also have the same charge in the CH3 domain of the second Fc region, provided that the charges in the first and second Fc regions are opposite.

In the above-mentioned Fc regions, for example, negatively-charged amino acid residues are preferably selected from glutamic acid (E) and aspartic acid (D), and positively-charged amino acid residues are preferably selected from lysine (K), arginine (R), and histidine (H).

Other known techniques can be used additionally for association of heterologous polypeptides comprising variant Fc regions. Specifically, such a technique is conducted by substituting an amino acid side chain present in one of the Fc regions with a larger side chain (knob; which means "bulge"), and substituting an amino acid side chain present in the Fc region with a smaller side chain (hole; which means "void"), to place the knob within the hole. This can promote efficient association between Fc-region-containing polypeptides having different amino acid sequences from each other (WO 1996/027011; Ridgway et al., *Prot. Eng.* 9:617-621 (1996); Merchant et al., *Nat.Biotech.* 16, 677-681 (1998)).

In addition, other known techniques can also be used for heterologous association of polypeptides comprising variant Fc regions. Association of polypeptides comprising an Fc region can be induced efficiently using strand-exchange engineered domain CH3 heterodimers (Davis et al., *Prot. Eng. Des. & Sel.*, 23:195-202 (2010)). This technique can also be used to efficiently induce association between Fc region-containing polypeptides having different amino acid sequences.

In addition, heterodimerized antibody production techniques that use association of antibody CH1 and CL, and association of VH and VL, which are described in WO 2011/028952, can also be used.

As with the method described in WO 2008/119353 and WO 2011/131746, it is also possible to use the technique of producing heterodimerized antibodies by producing two types of homodimerized antibodies in advance, incubating the antibodies under reducing conditions to dissociate them, and allowing them to associate again.

Furthermore, as with the method described in WO 2012/058768, it is also possible to use the technique of producing heterodimerized antibodies by adding alterations to the CH2 and CH3 domains.

When simultaneously expressing two polypeptides comprising a variant Fc region which have different amino acid sequences, in order to produce polypeptides comprising heterologous variant Fc regions, polypeptides comprising homologous variant Fc regions are also usually produced as impurities. In such cases, polypeptides comprising heterologous variant Fc regions can be efficiently obtained by separating and purifying them from polypeptides comprising homologous variant Fc regions using known technologies. A method has been reported to efficiently separate and purify heterodimerized antibodies from a homodimerized antibodies using ion exchange chromatography, by introducing amino acid alterations into the variable regions of the two types of antibody heavy chains to create a difference in isoelectric points between the homodimerized antibodies and the heterodimerized antibodies (WO 2007/114325). Another method has been reported to purify heterodimerized antibodies using Protein A chromatography, by constructing a heterodimerized antibody comprising two types of heavy chains derived from mouse IgG2a that binds to Protein A and rat IgG2b that does not bind to Protein A (WO 1998/050431 and WO 1995/033844).

Furthermore, a heterodimerized antibody can be efficiently purified using Protein A chromatography, by substituting amino acid residues at positions 435 and 436 (EU numbering), which are located in the Protein A binding site of an antibody heavy chain, with amino acids such as Tyr or His, to yield different Protein A binding affinities.

In the present invention, amino acid alteration means any of substitution, deletion, addition, insertion, and modification, or a combination thereof. In the present invention, amino acid alteration may be rephrased as amino acid mutation.

The number of amino acid alterations introduced into an Fc region is not limited. In certain embodiments, it can be 1, 2 or less, 3 or less, 4 or less, 5 or less, 6 or less, 8 or less, 10 or less, 12 or less, 14 or less, 16 or less, 18 or less, 20 or less, 22 or less, 24 or less, 26 or less, 28 or less, or 30 or less.

In one aspect, the present invention provides methods of producing a polypeptide comprising a variant Fc region. In further aspects, the present invention provides methods of producing a polypeptide comprising a variant Fc region whose function has been modified. In further aspects, the present invention provides methods for modifying a function of a polypeptide comprising an Fc region. In some aspects, the polypeptides are antibodies. In some aspects, the polypeptides are Fc fusion proteins. In certain embodiments, those methods comprise introducing at least one amino acid alteration into the parent Fc region. In certain embodiments, those methods comprise: (i) providing a polypeptide(s) comprising the parent Fc region; and (ii) introducing at least one amino acid alteration into the parent Fc region. In certain embodiments, those methods may further comprise (iii) measuring the function of the polypeptide(s) comprising the variant Fc region. A native Fc region is usually composed of two identical polypeptide chains. Amino acid alterations to the parent Fc region may be introduced into either one of the two polypeptide chains of the parent Fc region, or into both of the two polypeptide chains.

In another embodiment, the method of producing polypeptide(s) comprising a variant Fc region comprises: (i) providing one or more nucleic acids encoding polypeptides comprising the parent Fc region; (ii) introducing at least one mutation into the region(s) encoding the parent Fc region in the nucleic acids; (iii) introducing the nucleic acids produced in (ii) into a host cell; and (iv) culturing the cell described in (iii) such that the polypeptide(s) comprising the variant Fc region are expressed. In certain embodiments, the above methods may further comprise (v) collecting the polypeptide(s) comprising the variant Fc region from the host cell culture described in (iv).

In certain embodiments, the nucleic acids produced in (ii) may be included in one or more vectors (e.g., expression vectors).

In some embodiments, the amino acid alterations used in the production methods of the present invention are selected from any single alteration selected from among the amino acid alterations that can be comprised in the above-mentioned variant Fc regions, combinations of the single alterations, or the combined alterations listed in Tables 42 to 47.

An Fc region may be obtained by re-eluting the fraction adsorbed onto Protein A column after partially digesting IgG1, IgG2, IgG3, IgG4 monoclonal antibodies or such using a protease such as pepsin. The protease is not particularly limited as long as it can digest a full-length antibody so that Fab and F(ab')2 are produced in a restrictive manner by appropriately setting the enzyme reaction conditions such as pH, and examples include pepsin and papain.

The polypeptides comprising a variant Fc region of the present invention may be produced by other methods known in the art in addition to the above-mentioned production methods. The polypeptides comprising a variant Fc region produced by the production methods described herein are also included in the present invention.

In one embodiment, isolated nucleic acid encoding a polypeptide comprising a variant Fc region of the present invention is provided. Such nucleic acid may encode an amino acid sequence comprising the first polypeptide of the variant Fc region and/or an amino acid sequence comprising the second polypeptide of the variant Fc region. In a further embodiment, one or more vectors (e.g., expression vectors) comprising such nucleic acid are provided. In a further embodiment, a host cell comprising such nucleic acid is provided. In one such embodiment, a host cell comprises (e.g., has been transformed with): (1) a vector comprising a nucleic acid that encodes an amino acid sequence comprising the first polypeptide of the variant Fc region and an amino acid sequence comprising the second polypeptide of the variant Fc region, or (2) a first vector comprising a nucleic acid that encodes an amino acid sequence comprising the first polypeptide of the variant Fc region and a second vector comprising a nucleic acid that encodes an amino acid sequence comprising the second polypeptide of the variant Fc region. In one embodiment, the host cell is eukaryotic, e.g., a Chinese Hamster Ovary (CHO) cell or lymphoid cell (e.g., Y0, NS0, Sp2/0 cell). In one embodiment, a method of making a polypeptide comprising a variant Fc region of the present invention is provided, wherein the method comprises culturing a host cell comprising a nucleic acid encoding the polypeptide comprising a variant Fc region of the present invention under conditions suitable for expression of the polypeptide, and optionally recovering the polypeptide from the host cell (or host cell culture medium).

For recombinant production of a polypeptide comprising a variant Fc region of the present invention, nucleic acid encoding the polypeptide is isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the Fc region of the antibody).

Suitable host cells for cloning or expression of vectors encoding a polypeptide comprising a variant Fc region of the present invention include prokaryotic or eukaryotic cells.

In addition to prokaryotes, eukaryotic microbes such as filamentous fungi or yeast are suitable cloning or expression hosts for vectors encoding a polypeptide comprising a variant Fc region of the present invention, including fungi and yeast strains whose glycosylation pathways have been "humanized," resulting in the production of an antibody Fc region with a partially or fully human glycosylation pattern. See Gerngross, Nat. Biotech. 22:1409-1414 (2004), and Li et al., Nat. Biotech. 24:210-215 (2006).

Suitable host cells for the expression of glycosylated antibody Fc region are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells.

Plant cell cultures can also be utilized as hosts. See, e.g., U.S. Pat. Nos. 5,959,177, 6,040,498, 6,420,548, 7,125,978, and 6,417,429.

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., *J. Gen Virol.* 36:59 (1977)); baby hamster kidney cells (BHK); mouse sertoli cells (TM4 cells as described, e.g., in Mather, *Biol. Reprod.* 23:243-251 (1980)); monkey kidney cells (CV1); African green monkey kidney cells (VERO-76); human cervical carcinoma cells (HELA); canine kidney cells (MDCK); buffalo rat liver cells (BRL 3A); human lung cells (W138); human liver cells (Hep G2); mouse mammary tumor (MMT 060562); TRI cells, as described, e.g., in Mather et al., *Annals N.Y. Acad. Sci.* 383:44-68 (1982); MRC 5 cells; and FS4 cells. Other useful mammalian host cell lines include Chinese hamster ovary (CHO) cells, including DHFR CHO cells (Urlaub et al., *Proc. Natl. Acad. Sci. USA* 77:4216 (1980)); and myeloma cell lines such as Y0, NS0 and Sp2/0.

The assay methods described herein or various measurement methods known in the art may be used for identifying or screening for the variant Fc regions provided herein, or for elucidating their physical or chemical properties or biological activities.

Assays for determining the binding activity of a polypeptide containing a variant Fc region towards one or more FcR family members are described herein or otherwise known in the art. Such binding assays include but are not limited to surface plasmon resonance assay, Amplified Luminescent Proximity Homogeneous Assay (ALPHA) screening, ELISA, and fluorescence activated cell sorting (FACS) (Lazar et al., *Proc. Natl. Acad. Sci. USA* (2006) 103 (11): 4005-4010).

In one embodiment, the binding activity of the polypeptide comprising a variant Fc region to FcR family members can be measured using a surface plasmon resonance assay. For example, various FcRs are subjected to interaction as analytes with a polypeptide comprising a variant Fc region immobilized or captured onto a sensor chip by using known methods and reagents (e.g., Protein A, Protein L, Protein A/G, Protein G, anti-λ chain antibodies, anti-κ chain antibodies, antigenic peptides, and antigenic proteins). Alternatively, FcRs may be immobilized or captured onto a sensor chip, and a polypeptide comprising a variant Fc region may be used as an analyte. As a result of such interactions, binding sensorgrams are obtained and by analyzing them, the dissociation constant (KD) values of such bindings can be calculated. Moreover, the difference in the resonance unit (RU) value in sensorgrams before and after being subjected to interaction with an FcR (i.e., the binding amount of the FcR) can be used as an indicator of the binding activity of a polypeptide comprising a variant Fc region to the FcR. Furthermore, the corrected value obtained by dividing the above-mentioned binding amount of the FcR by the difference in the RU value in the sensorgrams before and after the polypeptide comprising a variant Fc region are immobilized or captured onto the sensor chip (i.e., the binding amount of the polypeptide comprising a variant Fc region) (that is, the correction value is the binding amount of the FcR per unit amount of the polypeptide comprising a variant Fc region) may be used as an indicator of the binding activity.

Any of the polypeptides comprising a variant Fc region provided herein may be used in therapeutic methods.

XIn one aspect, a polypeptide comprising a variant Fc region for use as a medicament is provided. In further aspects, a polypeptide comprising a variant Fc region for use in treating tumor is provided. In certain embodiments, a polypeptide comprising a variant Fc region for use in a method of treatment is provided. In certain embodiments, the present invention provides a polypeptide comprising a variant Fc region for use in a method of treating an individual having tumor comprising administering to the individual an effective amount of the polypeptide comprising a variant Fc region. In one such embodiment, the method further comprises administering to the individual an effective amount of at least one additional therapeutic agent. In further embodiments, the present invention provides a polypeptide comprising a variant Fc region for use in damaging cells. In certain embodiments, the present invention provides a polypeptide comprising a variant Fc region for use in a method of damaging cells in an individual comprising administering to the individual an effective amount of the polypeptide comprising a variant Fc region to damage cells. An "individual" according to any of the above embodiments is preferably a human.

In some embodiments, the tumor is a solid tumor. In a solid tumor, tumor cells usually proliferate to form a population, and the tumor tissue is formed mainly by these cells. Furthermore, tumor tissues in living organisms are often infiltrated by immune cells such as lymphocytes, which also constitute part of tumor tissues. In one embodiment, damage to cells is elicited by ADCC activity, CDC activity, or ADCP activity.

In a further aspect, the present invention provides for the use of a polypeptide comprising a variant Fc region in the manufacture or preparation of a medicament. In one embodiment, the medicament is for treatment of tumor. In a further embodiment, the medicament is for use in a method of treating tumor comprising administering to an individual having tumor an effective amount of the medicament. In one such embodiment, the method further comprises administering to the individual an effective amount of at least one additional therapeutic agent. In a further embodiment, the medicament is for damaging cells. In a further embodiment, the medicament is for use in a method of damaging cells in an individual comprising administering to the individual an effective amount of the medicament to damage cells. An "individual" according to any of the above embodiments may be a human.

In a further aspect, the present invention provides a method for treating a tumor. In one embodiment, the method comprises administering to an individual having such tumor an effective amount of a polypeptide comprising a variant Fc region. In one such embodiment, the method further comprises administering to the individual an effective amount of at least one additional therapeutic agent. An "individual" according to any of the above embodiments may be a human.

In a further aspect, the present invention provides a method for damaging cells in an individual. In one embodiment, the method comprises administering to the individual an effective amount of a polypeptide comprising a variant Fc region to damage cells. In one embodiment, an "individual" is a human.

In a further aspect, the present invention provides pharmaceutical formulations (pharmaceutical compositions) comprising any of the polypeptides comprising a variant Fc region provided herein. In one embodiment, the above-mentioned pharmaceutical formulation (pharmaceutical composition) further comprises a pharmaceutically acceptable carrier. In one embodiment, the present invention provides a pharmaceutical formulation (pharmaceutical composition) for use in treating tumor. In one embodiment, the present invention provides a pharmaceutical formulation (pharmaceutical composition) for use in damaging cells. In another embodiment, a pharmaceutical formulation (pharmaceutical composition) comprises a polypeptide comprising a variant Fc region provided herein and at least one additional therapeutic agent.

Anti-CTLA-4 Antibodies Comprising a Variant Fc Region

In one aspect, the present invention provides isolated antibodies that bind to CTLA-4 and comprise a variant Fc region. In some embodiments, an anti-CTLA-4 antibody of the present invention comprises a variable region having CTLA-4-binding activity dependent on the concentration of an adenosine-containing compound. In some embodiments, an anti-CTLA-4 antibody of the present invention comprises a variant Fc region comprising a plurality of amino acid alterations in a parent Fc region, wherein the variant Fc region comprises amino acid alterations at positions 234, 235, 236, 239, 268, 270, 298, 326, 330, and 334 according to EU numbering. In a specific embodiment, the present invention provides an anti-CTLA-4 antibody comprising:
  (A) a variable region having CTLA-4-binding activity dependent on the concentration of an adenosine-containing compound; and
  (B) a variant Fc region comprising a plurality of amino acid alterations in a parent Fc region,
    wherein the parent Fc region is composed of two polypeptide chains, and wherein the variant Fc region comprises amino acid alterations at the following positions:
      (i) positions 234, 235, 236, 239, 268, 270, 298, and 330 according to EU numbering in the first polypeptide of the parent Fc region; and
      (ii) positions 270, 298, 326, 330, and 334 according to EU numbering in the second polypeptide of the parent Fc region.

In one embodiment, the present invention provides an anti-CTLA-4 antibody comprising the first H chain polypeptide of SEQ ID NO: 335, the second H chain polypeptide of SEQ ID NO: 336, and the L chain polypeptides of SEQ ID NO: 161. In one embodiment, the present invention provides an anti-CTLA-4 antibody comprising the first H chain polypeptide of SEQ ID NO: 337, the second H chain polypeptide of SEQ ID NO: 338, and the L chain polypeptides of SEQ ID NO: 161. In one embodiment, the present invention provides an anti-CTLA-4 antibody comprising a first H chain polypeptide of SEQ ID NO: 385, a second H chain polypeptide of SEQ ID NO: 386, and an L chain polypeptide of SEQ ID NO: 161. In one embodiment, the present invention provides an anti-CTLA-4 antibody comprising a first H chain polypeptide of SEQ ID NO: 368, a second H chain polypeptide of SEQ ID NO: 369, and an L chain polypeptide of SEQ ID NO: 161.

EXAMPLE

Below are examples for illustrating embodiments encompassed by the present invention. It will be understood that various other embodiments can be carried out in view of the above-mentioned general descriptions.

Example 0

Concept of a switch antibody that exerts antibody-dependent cytotoxic activity against cell surface markers of regulatory T cells only under cancer microenvironments Ipilimumab was thought to exert its antitumor effect by inhibiting the suppression of effector T cell activation by CTLA4 expressed on the surface of effector T cells; recently however, antibody-dependent cytotoxic activity (ADCC activity) against CTLA4-expressing T cells was reported to be important, and it has been found that the removal of regulatory T cells in tumors and ADCC activity are important action mechanisms of the antitumor effect of anti-CTLA4 antibodies.

Additionally, it is known that the ADCC activity by IgG1 antibodies is a result of the induction of cytotoxic activity due to the binding of the antibody constant region to FcγRs of NK cells and macrophages, and antibodies with a constant region modified to enhance such binding induce a stronger cytotoxic activity, exerting an antitumor effect.

On the other hand, removal of regulatory T cells in the whole body has been reported to cause an autoimmune disease-like systemic reaction, and it is considered that the regulation of the balance between the cytotoxic activity for exerting an antitumor effect and systemic response is very important.

More specifically, an antibody is expected to exert a more potent cytotoxic activity and to be able to suppress systemic responses when the antibody can strongly bind to regulatory T cells or exhausted T cells in the cancer microenvironment, exert a potent antitumor effect by removing regulatory T cells or exhausted T cells by cytotoxic activity, and limit the response only to the cancer microenvironment. Antibodies with such an action mechanism are yet to be reported. Therefore, we actually generated and verified antibodies (CTLA4 switch antibodies) that act against CTLA4 only locally at a tumor and comprise a constant region with enhanced binding to FcγR(s) expressed on NK cells and macrophages.

Example 1

Production of Anti-CTLA4 Switch Antibodies Having a Modified Fc Region
(1-1) Expression and Purification of Anti-CTLA4 Switch Antibodies Having a Modified Fc Region Various anti-CTLA4 switch antibodies (04H1654-KT473/04L1610-lam1//04H1656-HT451/04L1610-lam1 (Abbreviated name: SW1610-ART5+ACT1), 04H1654-KT456/04L1610-lam1//04H1656-HT446/04L1610-lam1 (Abbreviated name: SW1610-ART4), and 04H1654-KT498/04L1610-lam1//04H1656-HT518/04L1610-lam1 (Abbreviated name: SW1610-ART12)) having a modified Fc region were produced by combining the Fc region introduced with the alterations identified in Reference Examples 6 and 7, and the variable regions of the anti-CTLA4 switch antibody produced in Reference Example 4.

The SW1610-ART5+ACT1 antibody was produced by combining the heavy chain and light chain genes produced in Reference Example 6. Specifically, 04H1654-KT473 (SEQ ID NO: 184) was used as one of the heavy chains and 04H1656-HT451 (SEQ ID NO: 272) was used as the other heavy chain, and 04L1610-lam1 (SEQ ID NO: 161) was used as the light chain, and expression and purification were carried out by methods known to those skilled in the art.

For the SW1610-ART4 antibody, as one of the heavy chains, the gene of antibody heavy chain 04H1654-KT456 (SEQ ID NO: 335) was produced, wherein the C-terminal Gly and Lys were removed from human IgG1(IGHG1*03), the CH2 region has the same alterations as Kn456 described in Reference Example 7, the CH3 region has the E356K alteration described in WO2006/106905 as promoting heterodimerization, and 04H1654 (SEQ ID NO: 140) is comprised as the heavy chain variable region. Similarly, the gene of antibody heavy chain 04H1656-HT446 (SEQ ID NO: 336) was produced, wherein the C-terminal Gly and Lys were removed from human IgG1 (IGHG1*03), the CH2 region has the same alterations as H1446 described in Reference Example 7, the CH3 has the K439E alteration described in WO2006/106905 as promoting heterodimerization, and 04H1656 (SEQ ID NO: 141) is comprised as the heavy chain variable region. Further, 04L1610-lam1 (SEQ ID NO: 161) was used as the light chain, and expression and purification were performed by methods known to those skilled in the art.

For the SW1610-ART12 antibody, similarly, as one of the heavy chains, the gene of antibody heavy chain 04H1654-KT498 (SEQ ID NO: 337) was produced, wherein the C-terminal Gly and Lys were removed from human IgG1 (IGHG1*03), the CH2 region has the same alterations as Kn498 described in Reference Example 7, the CH3 region has the E356K alteration described in WO2006/106905 as promoting heterodimerization, and 04H1654 (SEQ ID NO: 140) is comprised as the heavy chain variable region. Similarly, the gene of antibody heavy chain 04H1656-HT518 (SEQ ID NO: 338) was produced, wherein the C-terminal Gly and Lys were removed from human IgG1 (IGHG1*03), the CH2 region has the same alterations as H1518 described in Reference Example 7, the CH3 region has the K439E alteration described in WO2006/106905 as promoting heterodimerization, and 04H1656 (SEQ ID NO: 141) is comprised as the heavy chain variable region. Further, 04L1610-lam1 (SEQ ID NO: 161) was used as the light chain, and expression and purification were performed by methods known to those skilled in the art.

In the present specification, heterodimerized antibodies (antibodies having two different heavy chain polypeptides, and/or two different light chain polypeptides) are named according to the following rule: (first heavy chain variable region)–(first heavy chain constant region)/(first light chain variable region)–(first light chain constant region)//(second heavy chain variable region)–(second heavy chain constant region)/(second light chain variable region)–(second light chain constant region). For example, the antibody name 04H1654-KT456/04L1610-lam1//04H1656-HT446/04L1610-lam1 indicates that in this antibody, the first heavy chain variable region is 04H1654, the first heavy chain constant region is KT456, the first light chain variable region is 04L1610, the first light chain constant region is lam1, the second heavy chain variable region is 04H1656, the second heavy chain constant region is HT446, the second light chain variable region is 04L1610, and the second light chain constant region is lam1.

As used herein, the name of each heavy chain constant region corresponds to the SEQ ID NOs as follows: KT456 (SEQ ID NO: 358), HT446 (SEQ ID NO: 359), KT498 (SEQ ID NO: 360), HT518 (SEQ ID NO: 361), Kp125 (SEQ ID NO: 362), Hp076 (SEQ ID NO: 363), Kp462 (SEQ ID NO: 364), Kp473 (SEQ ID NO: 365), Hp441 (SEQ ID NO: 366), Hp451 (SEQ ID NO: 367).

(1-2) Measuring the Binding Activity of Anti-CTLA4 Switch Antibodies Having a Modified Fc Region for Various FcγRs The binding activity of the antibody produced in Example 1-1, 04H1654-KT498/04L1610-lam1//04H1656-HT518/04L1610-lam1 (SW1610-ART12), for each human FcγR (herein after referred to as hFcγR) and for each cynomolgus monkey FcγR (herein after referred to as cyFcγR) was evaluated using Biacore 8k+ (Cytiva). Here, Tremfya (Janssen Pharmaceutical K.K), which is an IgG1 antibody in which the L-chain is a λ-chain, was also evaluated as a control. The binding activity was evaluated at 25° C. using as a running buffer 50 mM phosphate buffer, 150 mM NaCl, 0.05 w/v %-P20, pH7.4. As a molecule for ligand capture, CaptureSelect (trademark) Human Fab-lambda Kinetics Biotin Conjugate (ThermoFisher scientific) was immobilized onto a Series S Sensor chip SA sensor chip (Cytiva). An antibody solution prepared with the running buffer was allowed to interact with the SA sensor chip for capturing about 250 RU, or 500 RU, or about 1000 RU, of antibody. Then, hFcγRs and cyFcγRs diluted with the running buffer were allowed to bind to the captured antibodies. Here, hFcγRs and cyFcγRs were diluted to five or more concentrations at a common ratio of 2, with the concentrations described in Table 2 as the maximum concentration, and used for the measurements. The chip was regenerated using 10 mM Glycine-HCl (pH 1.5), and measurements were performed by repeatedly capturing the antibodies. The binding activity of each antibody for each FcγR was evaluated by calculating the KD value using the Biacore Insight Evaluation Software with the Steady state model or 1:1 binding model.

TABLE 2

Maximum concentration of FcγRs used for measurements

|  | SW1610-ART12 | Tremfya |
|---|---|---|
| hFcγRIa | 6 nM | 12 nM |
| hFcγRIIa(H) | 800 nM | 4000 nM |
| hFcγRIIa(R) | 5000 nM | 5000 nM |
| hFcγRIIb | 100000 nM | 50000 nM |
| hFcγRIIIa(V) | 30 nM | 2400 nM |
| hFcγRIIIa(F) | 50 nM | 48000 nM |
| cyFcγRIa | 3 nM | 3 nM |
| cyFcγRIIa1 | 1200 nM | 20000 nM |
| cyFcγRIIa2 | 8000 nM | 20000 nM |
| cyFcγRIIa3 | 12000 nM | 96000 nM |
| cyFcγRIIb | 25035 nM | 25035 nM |
| cyFcγRIIIa(R) | 24 nM | 1600 nM |
| cyFcγRIIIa(S) | 24 nM | 1600 nM |

The hFcγRs and cyFcγRs used as analytes were prepared according to the following method.

The gene sequences of the extracellular domain of hFcγRs were obtained from hFcγRIa (NCBI reference sequence: NM_000566.3), hFcγRIIa (NCBI reference sequence: NM_001136219.1), hFcγRIIb (NCBI reference sequence: NM_004001.3), hFcγRIIIa (NCBI reference sequence: NM_001127593.1), and the polymorphic sites were designed with reference to the following documents (regarding hFcγRIIaR, Warmerdam, P. A. M. et al., 1990, J. Exp. Med. 172:19-25; and regarding hFcγRIIIaR, Wu, J. et al., 1997, J. Clin. Invest. 100 (5): 1059-1070). The amino acid sequences of the extracellular domain of hFcγRs used for expression and purification are indicated in the Sequence Listing as follows: hFcγRIa (SEQ ID NO: 341), hFcγRIIa (H) (SEQ ID NO: 342), hFcγRIIa(R) (SEQ ID NO: 343), hFcγRIIb (SEQ ID NO: 344), hFcγRIIIa(F) (SEQ ID NO: 345), hFcγRIIIa(V) (SEQ ID NO: 346). Next, His tag was added to the C-terminus and each of the obtained genes was inserted into an expression vector designed for expression in mammalian cells by methods known to those skilled in the art. The expression vector was introduced into human fetal kidney cell-derived FreeStyle293 cells (Invitrogen) to express target proteins. After culturing, the obtained culture supernatant was, in principle, filtrated and purified by the following 4 steps, or by 3 steps excluding the initial anion exchange chromatography step. As the initial step, anion exchange chromatography using Q Sepharose Fast Flow (GE Healthcare) was carried out. As the second step, affinity chromatography against His tag using HisTrap HP (GE Healthcare) was carried out. As the third step, gel filtration column chromatography using HiLoad 26/600 Superdex 200 pg (GE Healthcare) was carried out. As the fourth step, sterile filtration was carried out. Absorbance of the purified protein at 280 nm was measured using a spectrophotometer, and the concentration of the purified protein was determined using the absorption coefficient calculated by the PACE method (Protein Science 4:2411-2423 (1995)).

The genes of the extracellular domain of cyFcγRs were constructed by cloning the cDNA of cyFcγRs using methods known to those skilled in the art. The amino acid sequences of the extracellular domain of cyFcγRs are indicated in the Sequence Listing as follows: cyFcγRIa (SEQ ID NO: 347), cyFcγRIIa1 (SEQ ID NO: 348), cyFcγRIIa2 (SEQ ID NO: 349), cyFcγRIIa3 (SEQ ID NO: 350), cyFcγRIIb (SEQ ID NO: 351), cyFcγRIIIa(R) (SEQ ID NO: 352), cyFcγRIIIa(S) (SEQ ID NO: 353). Next, the gene sequence encoding His tag was attached to 3' terminal of each gene. Each of the obtained genes was inserted into an expression vector designed for expression in mammalian cells by methods known to those skilled in the art. The expression vector was introduced into human fetal kidney cell-derived FreeStyle293 cells (Invitrogen) to express target proteins. After culturing, the obtained culture supernatant was, in principle, filtrated and purified by the following 4 steps. As the initial step, cation exchange chromatography using SP Sepharose FF was carried out. As the second step, affinity chromatography against His tag (HisTrap HP) was carried out. As the third step, gel filtration column chromatography (Superdex200) was carried out. As the fourth step, sterile filtration was carried out. Absorbance of the purified protein at 280 nm was measured using a spectrophotometer, and the concentration of the purified protein was determined using the absorption coefficient calculated by the PACE method (Protein Science 4:2411-2423 (1995)).

Table 3 shows the KD values of SW1610-ART12 and Tremfya for each hFcγR, and Table 4 shows the KD values of SW1610-ART12 and Tremfya for cyFcγRs. In Table 3, regarding SW1610-ART12, the KD values for hFcγRIIa(H), hFcγRIIa(R), hFcγRIIIa(V), and hFcγRIIIa(F) were smaller than those regarding Tremfya. Further, in Table 4, regarding SW1610-ART12, the KD values for cyFcγRIIa1, cyFcγRIIa2 and cyFcγRIIa3, and cyFcγRIIIa(R) and cyFcγRIIIa(S) were smaller than those regarding Tremfya.

TABLE 3

KD values of SW1610-ART12 and Tremfya for hFcγRs

|  | SW1610-ART12 | | Tremfya | |
|---|---|---|---|---|
|  | $K_D$ (mol/L) Mean value | Standard deviation | $K_D$ (mol/L) Mean value | Standard deviation |
| hFcγRIa | $3.87 \times 10^{-11}$ | $2.65 \times 10^{-13}$ | $9.08 \times 10^{-11}$ | $1.76 \times 10^{-12}$ |
| hFcγRIIa(H) | $3.43 \times 10^{-7}$ | $1.00 \times 10^{-9}$ | $1.25 \times 10^{-6}$ | $5.77 \times 10^{-9}$ |

TABLE 3-continued

KD values of SW1610-ART12 and Tremfya for hFcγRs

|  | SW1610-ART12 | | Tremfya | |
|---|---|---|---|---|
|  | $K_D$ (mol/L) Mean value | Standard deviation | $K_D$ (mol/L) Mean value | Standard deviation |
| hFcγRIIa(R) | $1.79 \times 10^{-6}$ | $5.77 \times 10^{-9}$ | $1.88 \times 10^{-6}$ | $1.15 \times 10^{-8}$ |
| hFcγRIIb | $3.88 \times 10^{-5}$ | $2.31 \times 10^{-7}$ | $1.65 \times 10^{-5}$ | $5.77 \times 10^{-8}$ |
| hFcγRIIIa(V) | $1.82 \times 10^{-9}$ | $5.77 \times 10^{-12}$ | $1.02 \times 10^{-6}$ | 0.00 |
| hFcγRIIIa(F) | $4.13 \times 10^{-9}$ | $2.08 \times 10^{-11}$ | $9.09 \times 10^{-6}$ | $1.53 \times 10^{-8}$ |

TABLE 4

KD values of SW1610-ART12 and Tremfya for cyFcγRs

|  | SW1610-ART12 | | Tremfya | |
|---|---|---|---|---|
|  | $K_D$ (mol/L) Mean value | Standard deviation | $K_D$ (mol/L) Mean value | Standard deviation |
| cyFcγRIa | $1.06 \times 10^{-11}$ | $5.77 \times 10^{-14}$ | $1.09 \times 10^{-11}$ | $2.65 \times 10^{-13}$ |
| cyFcγRIIa1 | $5.40 \times 10^{-7}$ | $2.08 \times 10^{-9}$ | $6.80 \times 10^{-6}$ | $2.31 \times 10^{-8}$ |
| cyFcγRIIa2 | $2.32 \times 10^{-6}$ | $5.77 \times 10^{-9}$ | $7.53 \times 10^{-6}$ | $2.65 \times 10^{-8}$ |
| cyFcγRIIa3 | $5.29 \times 10^{-6}$ | $1.53 \times 10^{-8}$ | $3.98 \times 10^{-5}$ | $1.00 \times 10^{-7}$ |
| cyFcγRIIb | $2.52 \times 10^{-6}$ | $1.53 \times 10^{-8}$ | $5.67 \times 10^{-6}$ | $4.16 \times 10^{-8}$ |
| cyFcγRIIIa(R) | $1.01 \times 10^{-9}$ | $5.77 \times 10^{-12}$ | $5.79 \times 10^{-7}$ | $4.00 \times 10^{-9}$ |
| cyFcγRIIIa(S) | $9.33 \times 10^{-10}$ | $7.00 \times 10^{-12}$ | $4.97 \times 10^{-7}$ | $2.52 \times 10^{-9}$ |

Example 2

Evaluation of In Vitro Pharmacological Activity of Anti-CTLA4 Switch Antibodies Having a Modified Fc Region (2-1) ADCC Activity of Anti-CTLA4 Switch Antibodies Having a Modified Fc Region, Using Human Peripheral Blood Mononuclear Cells as Effector Cells The antibody concentration-dependent ADCC activity of the following antibodies produced in Example 1, which bind to an antigen in an ATP-dependent manner, was measured according to the method described below: 04H1654-KT473/04L1610-lam1//04H1656-HT451/04L1610-lam1 (SW1610-ART5+ACT1), 04H1654-KT456/04L1610-lam1//04H1656-HT446/04L1610-lam1 (SW1610-ART4), and 04H1654-KT498/04L1610-lam1//04H1656-HT518/04L1610-lam1 (SW1610-ART12). The ADCC activity of the test antibody was measured as described below using human peripheral blood mononuclear cells (herein after referred to as human PBMCs) as effector cells.

First, a human PBMC solution was prepared. Using a syringe prefilled with 200 L of a 1000 units/mL heparin solution (Novo-Heparin 5,000 units for Injection, Novo Nordisk), 50 mL of peripheral blood was collected from a healthy volunteer (adult male). The peripheral blood was diluted 2 times using PBS (−), divided into 4 equivalents, and added to Leucosep lymphocyte separation tubes (Greiner bio-one) prefilled with 15 ml of Ficoll-Paque PLUS and centrifuged. The separation tubes dispensed with the peripheral blood were centrifuged at a rate of 1000 rpm under room temperature for 10 minutes, and then the mononuclear cell fraction layers were collected. Cells contained in the fraction layers were washed once with RPMI-1640 (Sigma) containing 10% FBS (herein after referred to as 10% FBS/RPMI), and then the cells were suspended in 10% FBS/RPMI to make a cell density of $1 \times 10^7$ cells/mL. This suspension of cells was subjected to subsequent experiments as the human PBMC solution.

Next, CD4 positive T cells (CD4+ cells) were isolated from frozen PBMC in order to use CD4 positive T cells (CD4+ cells) stimulated with anti-CD3/28 antibody coated beads as target cells. CD4+ cells were isolated by negative selection using CD4 T cell isolation kit (Milteny biotec). The cells were then prepared at $4 \times 10^5$ cells/mL using 10% FBS/RPMI, equivalent amount of Dynabeads Human T-Activator CD3/CD28 was then added and incubated in a 5% $CO_2$ incubator at 37° C. for 4 days. Four days after stimulation, the cells were collected and subjected to experiments.

ADCC activity was evaluated with Cr51 (chromium-51) (J-RAM) release. To $2 \times 10^6$ of target cells, 90 μL of 10% FBS/RPMI and 10 μL of Cr51 solution were added, and the cells were incubated in a 5% $CO_2$ incubator at 37° C. for 2 hours for labeling in advance.

Then, the labeled target cells were washed with 10% FBS/RPMI, and prepared to make $2 \times 10^5$ cells/mL using 10% FBS/RPMI.

First, 50 μL of antibody solution prepared to each concentration (0, 0.00004, 0.0004, 0.004, 0.04, 0.4, 4, and 40 μg/mL), then 50 μl of ATP solution prepared with 10% FBS/RPMI to 0 or 400 μM, 50 μL of target cells ($1 \times 10^4$ cells/well), and 50 μL of human PBMC solution ($5 \times 10^5$ cells/well) were serially added to each well of a U-bottom 96-well plate, and the solutions were mixed and centrifuged, and the plate was allowed to stand in a 5% $CO_2$ incubator at 37° C. for 4 hours. After completion of the reaction, 50 μL of culture supernatant was collected and transferred to a 96-well plate for measurement, then the counting rate (counts per minute; cpm) of extracellularly released Cr was measured using Microbeta2 (Perkin Elmer). The ADCC activity was determined based on the following equation.

$$\text{ADCC activity (\%)} = \{(A-C)-(B-C)\} \times 100$$

Figure 1:
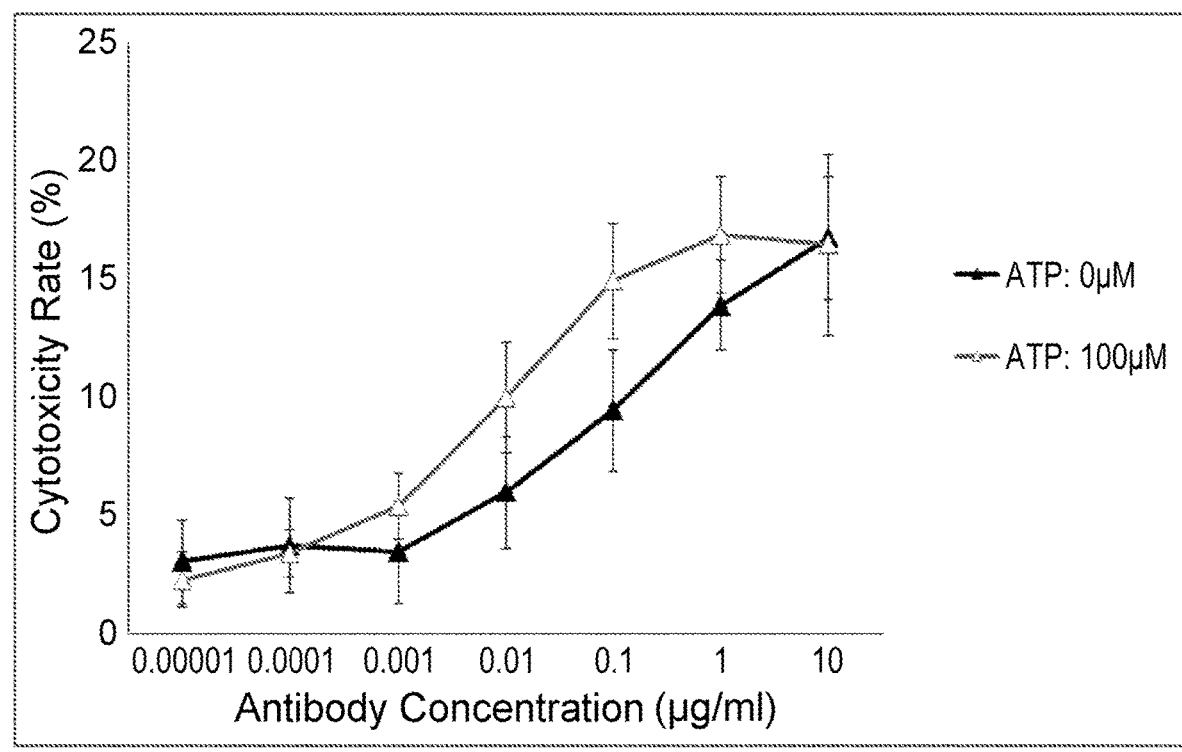
FIG. 1 shows the results of measuring the in vitro antibody dependent cellular cytotoxicity (ADCC) activity, in the presence or absence of ATP, of the anti-CTLA4 switch antibody, SW1610-ART5+ACT1, against CD4 positive T cells in which CTLA4 expression has been induced, as described in Example 2-1.
Figure 2:
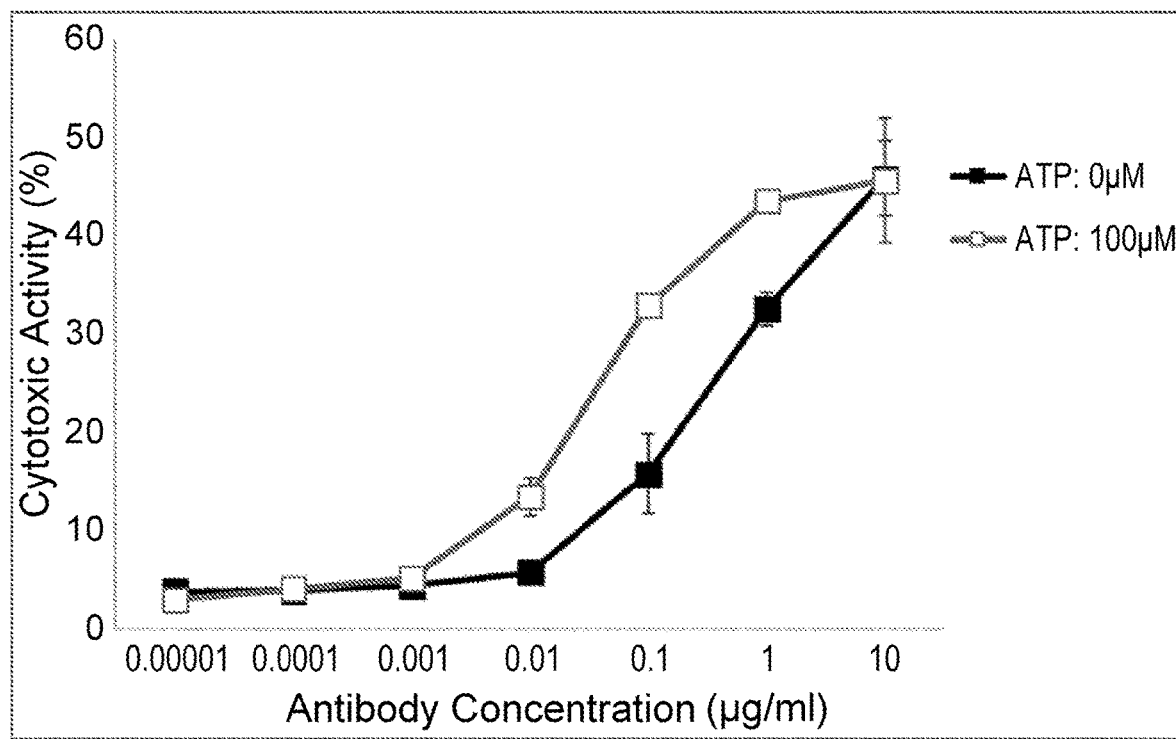
FIG. 2 shows the results of measuring the in vitro antibody dependent cellular cytotoxicity (ADCC) activity, in the presence or absence of ATP, of the anti-CTLA4 switch antibody, SW1610-ART12, against CD4 positive T cells in which CTLA4 expression has been induced, as described in Example 2-1.
Figure 3:
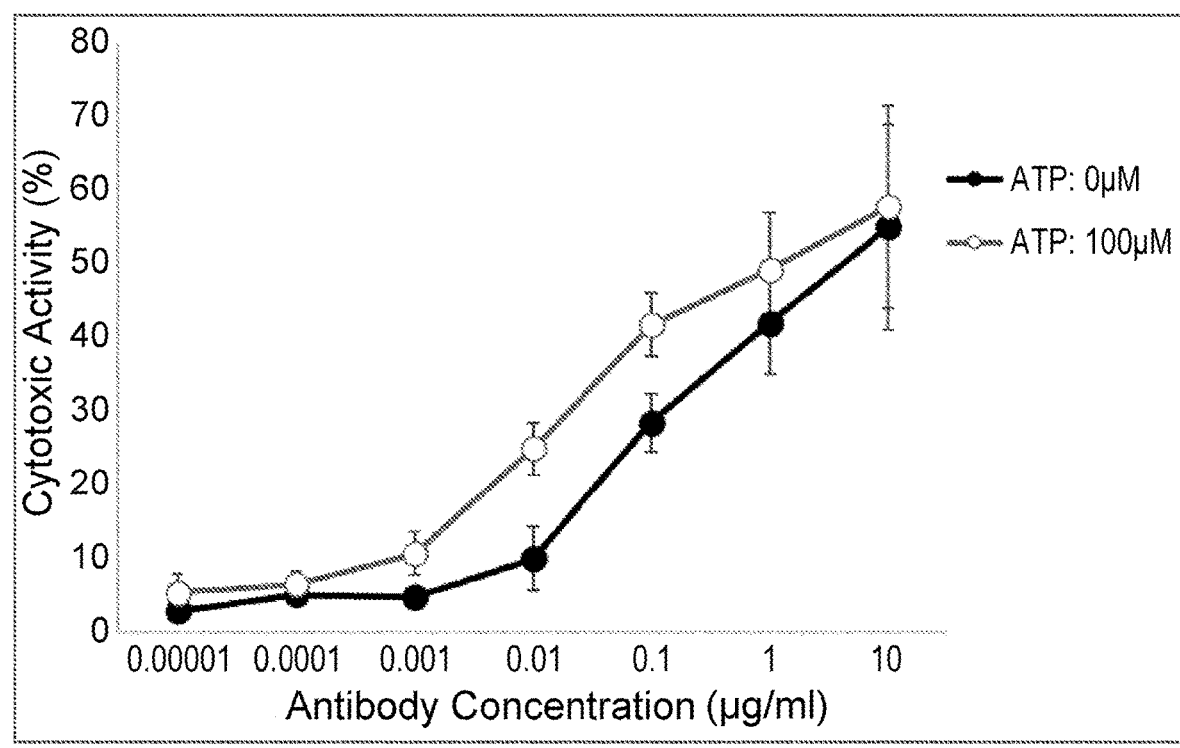
FIG. 3 shows the results of measuring the in vitro antibody dependent cellular cytotoxicity (ADCC) activity, in the presence or absence of ATP, of the anti-CTLA4 switch antibody, SW1610-ART4, against CD4 positive T cells in which CTLA4 expression has been induced, as described in Example 2-1.

In the above equation, A represents the mean value of the counting rate in wells added with the respective test antibody. Further, B represents the mean value of the counting rate in wells containing only the target cells and added with 50 µL of 4% NP-40 solution. C represents the mean value of the counting rate in wells containing only 10% FBS/RPMI. Tests were performed using 3 donor PBMCs for SW1610-ART5+ACT1, 2 donor PBMCs for SW1610-ART4 and SW1610-ART12 as effector cells, and the mean value of ADCC activity (%) was calculated for the tests reflecting the ADCC activity of test antibodies. The results are shown in FIGS. 1, 2, and 3. From the results, ATP-dependent ADCC activity was observed for anti-CTLA4 switch antibodies having a modified Fc.

Figure 4:
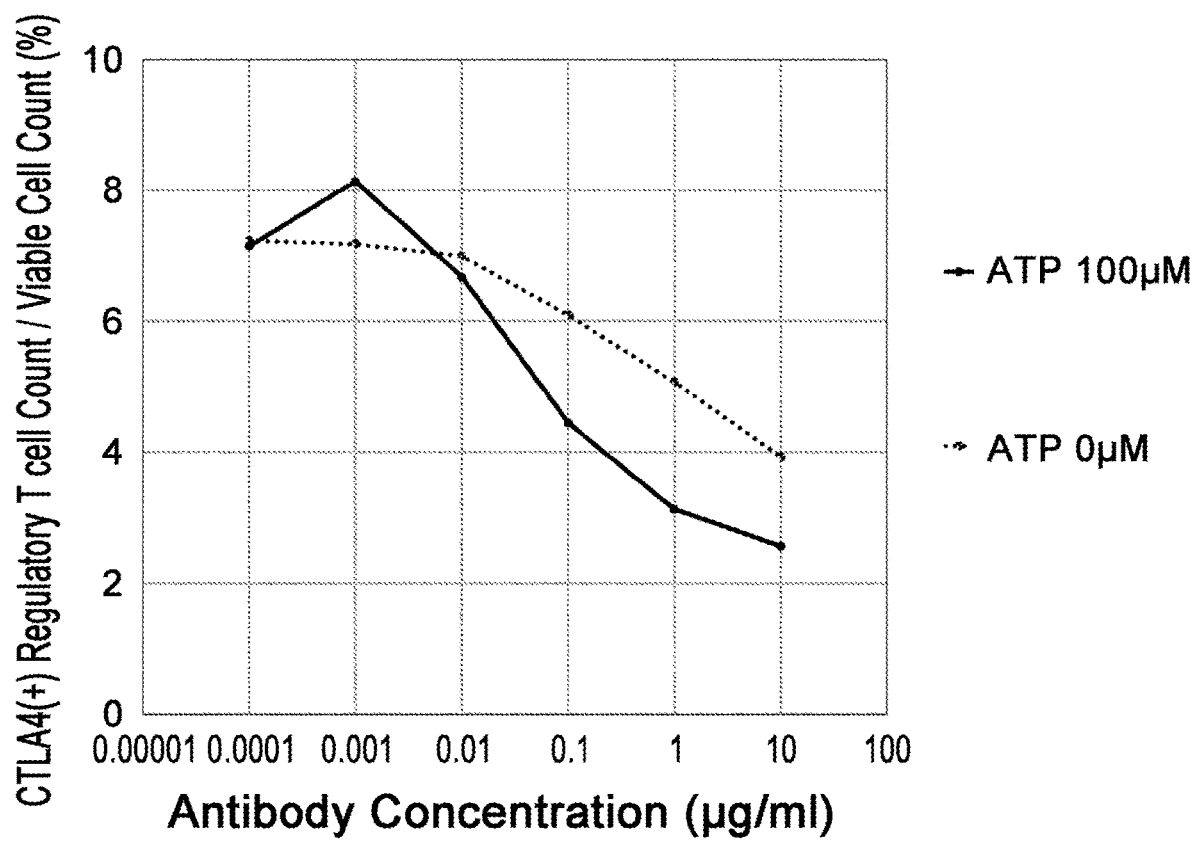
FIG. 4 shows the percentage of CD4 positive regulatory T (Treg) cells present in human peripheral blood mononuclear cells (PBMCs) when the anti-CTLA4 switch antibody, SW1610-ART12, is added in the presence or absence of ATP, as described in Example 2-2.

(2-2) Evaluation of ADCC Activity of Anti-CTLA4 Switch Antibodies Having a Modified Fc Region, Using Human Peripheral Blood Mononuclear Cells as Effector Cells In vitro cytotoxic activity of 04H1654-KT498/04L1610-lam1//04H1656-HT518/04L1610-lam1 (SW1610-ART12) produced in Example 1-1 for CTLA4 positive regulatory T cells (CD3+CD4+CD25+CD45RA-CTLA4+) was evaluated. First, human PBMCs (Cryopreserved Human PBMC, ASTARTE) were freeze-thawed and suspended in CD3/CD28 Ab Dynabeads (1:1)/OpTmizer/L-Gln/Penicillin-Streptomycin to make a cell density of $4 \times 10^5$ cells/mL, and this was incubated in a 5% $CO_2$ incubator at 37° C. for 7 days. After 7 days, the cells were collected and washed twice with 10% FBS/RPMI and then seeded into each well of a V-bottom 96-well plate at 50 µL per well ($1 \times 10^6$ cells/well). Next, antibody solution prepared with RPMI/10% FBS to each concentration (0.0003, 0.003, 0.03, 0.3, 3, 30 µg/mL) was added to each well of the V-bottom 96-well plate at 50 µL per well. Further, ATP solution prepared with RPMI/10% FBS to 0 or 300 µM was added at 50 µL per well, and after thoroughly suspending the cells, the plate was left to stand in a $CO_2$ incubator at 37° C. for 6 hours. After 6 hours, PBMCs were collected and washed twice with auto MACS Rinsing Solution (Milteny), and then allowed to react with the following antibodies to analyze the fraction of immune cells present with FACS analysis. Reagent for determining viability (Biolegend, Zombie Aqua), anti-CD3 antibody (BD, clone: UCHT1), anti-CD4 antibody (BD, clone: RPA-T4), anti-CD8 antibody (BD, clone: SK1), anti-CD45RA antibody (Biolegend, clone: 5 Hg), anti-CD25 antibody (BD, clone: 2A3), anti-CTLA4 antibody (Biolegend, clone: BNI3). FACS analysis was carried out using BD LSR Fortessa X-20 (BD). The obtained results are shown in FIG. 4.

From the results, it was confirmed that the cytotoxic activity of anti-CTLA4 switch antibodies having a modified Fc for CTLA4 positive regulatory T cells vary depending on the presence or absence of ATP, and that ATP-dependent cytotoxicity towards CTLA4 positive regulatory T cells exist.

Example 3

Safety Evaluation of Anti-CTLA4 Switch Antibodies Having a Modified Fc Region
(3-1) Production of Anti-CTLA4 Control Antibody and Anti-CTLA4 Switch Antibody for Cynomolgus Monkey Toxicity Test For the SW1389-ART1 antibody, as one of the heavy chains, the gene of antibody heavy chain 04H1389-Kp125 (SEQ ID NO: 339) was produced, wherein the C-terminal Gly and Lys were removed from human IgG1 (IGHG1*03), the CH2 region has the same alterations as Kn125 described in Reference Example 7, the CH3 region has the S354C/T366W alterations that promote heterodimerization, and 04H1389 (SEQ ID NO: 29) is comprised as the heavy chain variable region. Similarly, the gene of antibody heavy chain 04H1389-Hp076 (SEQ ID NO: 340) was produced, wherein the C-terminal Gly and Lys were removed from human IgG1 (IGHG1*03), the CH2 region has the same alterations as H1076 described in Reference Example 7, the CH3 region has the Y349C/T366S/L368A/Y407V alterations that promote heterodimerization, and 04H1389 (SEQ ID NO: 29) is comprised as the heavy chain variable region. Further, 04L1305-k0MT (SEQ ID NO: 275) was used as the light chain, and expression and purification were performed by methods known to those skilled in the art.

For the SW1389-ART5+ACT1 antibody, as one of the heavy chains, the gene of antibody heavy chain 04H1389-Kp462 (SEQ ID NO: 354) was produced, wherein the C-terminal Gly and Lys were removed from human IgG1 (IGHG1*03), the CH2 region has the same alterations as Kn462 described in Reference Example 7, the CH3 region has the S354C/T366W alterations that promote heterodimerization, and 04H1389 (SEQ ID NO: 29) is comprised as the heavy chain variable region, and further, a combination of alterations that improve the antibody blood kinetics described in Mabs, 2017, 9, 844-853 was introduced. Specifically, the gene of 04H1389-Kp473 (SEQ ID NO: 355) was produced, wherein N434A/Y436T/Q438R/S440E, which is a combination of alterations that increase binding to human FcRn under acidic conditions and alterations that reduce binding to Rheumatoid factor, was introduced into the CH3 region of 04H1389-Kp462. Similarly, the gene of 04H1389-Hp451 (SEQ ID NO: 357) was produced, wherein similar alterations were introduced into the antibody heavy chain 04H1389-Hp441 (SEQ ID NO: 356), wherein the C-terminal Gly and Lys were removed from human IgG1 (IGHG1*03), the CH2 region has the same alteration as H1441 described in Reference Example 7, the CH3 region has the Y349C/T366S/L368A/Y407V alterations that promote heterodimerization, and 04H1389 (SEQ ID NO: 29) is comprised as the heavy chain variable region. Further, 04L1305-k0MT (SEQ ID NO: 275) was used as the light chain, and expression and purification were performed by methods known to those skilled in the art.

Antibodies produced in Example 1-1 were used as the SW1610-ART4 antibody and SW1610-ART12 antibody.
(3-2) Conduct of Cynomolgus Monkey Toxicity Test For the purpose of evaluating and comparing toxicity including systemic reactions, the antibodies SW1389-ART1, SW1389-ART5+ACT1, SW1610-ART4, and SW1610-ART12 prepared in Example 3-1 were administered to cynomolgus monkeys (3 male, 3 female) once every week for a total of 5 administrations. As the dose of administration, 60 mg/kg, 20 mg/kg, 60 mg/kg, and 30 mg/kg were set, respectively, as a dose where the plasma concentration at 7 days after the first administration becomes constant for each antibody. Administration was carried out using a syringe pump for slow intravenous administration, and general condition was observed, body weight was measured, blood and blood chemistry tests were performed, autoantibodies in blood were measured, immunophenotyping was carried out, blood cytokine was measured, bone marrow tests were performed, pathological examinations were performed, and drug concentration in plasma was measured.

In many cases of all of the antibody groups, anti-drug antibodies were expressed and exposure was reduced accompanying thereto during the dosing period. Further, in all of the antibody-administered groups, autoantibodies were expressed, blood inflammatory parameters were increased, and slight to mild histopathological changes in the kidney were observed; however, there were no severe findings in the general condition, body weight and such, and tolerability was acknowledged.

Further, regarding the SW1610-ART12 antibody, 0.3 mg/kg and 3 mg/kg, which are 1-fold and 10-fold, respectively, of the estimated dose achieving medicinal effect, were similarly administered intravenously to cynomolgus monkeys (3 male, 3 female) once every week for a total of 5 administrations, and the general condition was observed, body weight was measured, blood and blood chemistry tests were performed, urine tests were performed, autoantibodies in blood were measured, immunophenotyping was carried out, blood cytokine was measured, bone marrow tests were performed, pathological examinations were performed, and drug concentration in plasma was measured.

In the groups administered with 0.3 mg/kg and 3 mg/kg of the SW1610-ART12 antibody also, in many cases, anti-drug antibodies were expressed and exposure was reduced accompanying thereto during the dosing period. In this test also, there were no severe findings in the general condition, body weight, and such; however, in the groups of 0.3 mg/kg or more, autoantibodies were expressed, blood inflammatory parameters were increased, and slight to mild histopathological changes in the kidney were observed, suggesting dose dependency of the incidence rate and severity of these toxicity changes. In view of the above, from the toxicity tests in cynomolgus monkeys using the SW1610-ART12 antibody, tolerability was acknowledged while dose dependency of the incidence rate and severity of various toxicity changes were observed up to 30 mg/kg, which corresponds to 100-fold of the estimated dose achieving medicinal effect.

Example 4

Preparation of Anti-Human CTLA4 Switch Antibodies with a Modified Fc Region which were Used in Various In Vitro Tests Anti-CTLA4 switch antibodies with a modified Fc region (04H1654-KT498/04L1610-lam1//04H1656-HT518/04L1610-lam1, abbreviated name: SW1610-ART12; and 04H1389-Kp473/04L1305-k0MT//04H1389-Hp451/04L1305-k0MT, abbreviated name: SW1389-ART5+ACT1) were each produced by combining the Fc region found in Reference Examples 6 and 7, into which a modification is introduced, and the variable region of the anti-CTLA4 switch antibody produced in Reference Example 4.

For one heavy chain of the SW1610-ART12 antibody, a gene of antibody heavy chain 04H1654-KT498 (SEQ ID NO: 368), where Gly and Lys at the C-terminus of human IgG1(IGHG1*03) were removed, the CH2 region has the same modification as Kn498 described in Reference Example 7, the CH3 region has the modification E356K that promotes heterodimerization disclosed in WO 2006/106905, and 04H1654 (SEQ ID NO: 140) is included as a heavy chain variable region, was produced. Similarly, a gene of antibody heavy chain 04H1656-HT518 (SEQ ID NO: 369), where Gly and Lys at the C-terminus of human IgG1 (IGHG1*03) were removed, the CH2 region has the same modification as H1518 described in Reference Example 7, the CH3 region has the modification K439E that promotes heterodimerization disclosed in WO 2006/106905, and 04H1656 (SEQ ID NO: 141) is included as a heavy chain variable region, was produced. As light chains, 04L1610-lam1 (SEQ ID NO: 161) was used and the antibody was expressed and purified by methods known to those skilled in the art.

For one heavy chain of the SW1389-ART5+ACT1 antibody, a gene of antibody heavy chain 04H1389-Kp462 (SEQ ID NO: 370), where Gly and Lys at the C-terminus of human IgG1(IGHG1*03) were removed, the CH2 region has the same modification as Kn462 described in Reference Example 7, the CH3 region has the modifications S354C/T366W that promote heterodimerization, and 04H1389 (SEQ ID NO: 29) is included as a heavy chain variable region, was produced. Furthermore, the combination of modifications that improve blood kinetics of antibodies disclosed in Mabs, 2017, 9, 844-853 was introduced. Specifically, a gene of 04H1389-Kp473 (SEQ ID NO: 371), where N434A/Y436T/Q438R/S440E, which is a combination of modifications that enhance the binding to human FcRn and reduce the binding to Rheumatoid factor under acidic conditions, was introduced into the CH3 region of 04H1389-Kp462, was produced. Similarly, the same modifications were introduced into antibody heavy chain 04H1389-Hp441 (SEQ ID NO: 372), where Gly and Lys at the C-terminus of human IgG1(IGHG1*03) were removed, the CH2 region has the same modification as H1441 described in Reference Example 7, the CH3 region has the modifications Y349C/T366S/L368A/Y407V that promote heterodimerization, and 04H1389 (SEQ ID NO: 29) is included as a heavy chain variable region, to produce a gene of 04H1389-Hp451 (SEQ ID NO: 373). As light chains, 04L1305-k0MT (SEQ ID NO: 275) was used and the antibody was expressed and purified by methods known to those skilled in the art.

Moreover, for control antibodies, MDX10D1H-G1m/MDX10D1L-k0MT with abbreviated name Ipilimumab and IC17HdK-G1m/IC17L-k0 with abbreviated name KLH-G1m, which mimics IgG1 in vivo, were produced. By using MDX10D1H-G1m (SEQ ID NO: 210) as a heavy chain and MDX10D1L-k0MT (SEQ ID NO: 211) as a light chain, Ipilimumab was expressed and purified by methods known to those skilled in the art. By using IC17HdK-G1m (SEQ ID NO: 374) as a heavy chain and IC17L-k0 (SEQ ID NO: 375) as a light chain, KLH-G1m was expressed and purified by methods known to those skilled in the art. In the present specification, heterodimerized antibodies (antibodies having two different heavy chain polypeptides and/or two different light chain polypeptides) are named according to the following rule: (the first heavy chain variable region)–(the first heavy chain constant region)/(the first light chain variable region)–(the first light chain constant region)//(the second heavy chain variable region)–(the second heavy chain constant region)/(the second light chain variable region)–(the second light chain constant region). For example, the antibody name 04H1654-KT456/04L1610-lam1//04H1656-HT446/04L1610-lam1 indicates that the first heavy chain variable region of the antibody is 04H1654, the first heavy chain constant region is KT456, the first light chain variable region is 04L1610, the first light chain constant region is lam1, the second heavy chain variable region is 04H1656, the second heavy chain constant region is HT446, the second light chain variable region is 04L1610, and the second light chain constant region is lam1.

The correspondence between the names of each heavy chain constant region used herein and SEQ ID NOs is as follows: KT498 (SEQ ID NO: 376), HT518 (SEQ ID NO: 377), Kp462 (SEQ ID NO: 378), Kp473 (SEQ ID NO: 379), Hp441 (SEQ ID NO: 380), Hp451 (SEQ ID NO: 381), KT456 (SEQ ID NO: 383), and HT446 (SEQ ID NO: 384).

For one heavy chain of the SW1610-ART4 antibody, a gene of antibody heavy chain 04H1654-KT456 (SEQ ID NO: 385), where Gly and Lys at the C-terminus of human IgG1 (IGHG1*03) were removed, the CH2 region has the same modification as Kn456 described in Reference Example 7, the CH3 region has the modification E356K that promotes heterodimerization disclosed in WO 2006/106905, and 04H1654 (SEQ ID NO: 140) is included as a heavy chain variable region, was produced. Similarly, a gene of antibody heavy chain 04H1656-HT446 (SEQ ID NO: 386), where Gly and Lys at the C-terminus of human IgG1 (IGHG1*03) were removed, the CH2 region has the same modification as H1446 described in Reference Example 7, the CH3 region has the modification K439E that promotes heterodimerization disclosed in WO 2006/106905, and 04H1656 (SEQ ID NO: 141) is included as a heavy chain variable region, was produced. As light chains, 04L1610-lam1 (SEQ ID NO: 161) was used and the antibody was expressed and purified by methods known to those skilled in the art.

Example 5

Assessment of In Vivo Drug Efficacy of Anti-CTLA4 Switch Antibodies in Mouse Models Transplanted with Various Syngeneic Tumor Lines (5-1) Assessment of Drug Efficacy of an Anti-CTLA4 Switch Antibody in a Syngeneic Tumor Cell Transplant Model (Colon Cancer Model) Using Wild-Type Mice (5-1-1) the Cell Line and Production of a Syngeneic Tumor Line Transplant Mouse Model Mouse colon cancer line CT26 cells were purchased from ATCC and used in the experiment. CT26 cells were maintained and passaged in the RPMI1640 medium (SIGMA) containing 10% FBS (SIGMA), 1 mM Sodium Pyruvate (GIBCO), 10 mM HEPES (SIGMA), and 0.45% D-glucose (SIGMA). The used mice were BALB/c mice (7-week-old, female) purchased from CHARLES RIVER LABORATORIES JAPAN, INC.

The volume of transplanted tumor was calculated by the following formula:

Tumor volume=long diameter×short diameter×short diameter/2

(5-1-2) PREPARATION of agents for administration

The anti-mouse CTLA4 control antibody (mNS-mFa55) prepared in Reference Example 3-4 and the anti-CTLA4 switch antibody (SW1208-mFa55) were administered to the CT26 cell transplant model as the agents for administration. With His-buffer (20 mM His-HCl and 150 mM NaCl, pH 6.0), mNS-mFa55 was adjusted to 0.1 mg/mL, 0.2 mg/mL, 0.4 mg/mL, and 0.8 mg/mL and SW1208-mFa55 was adjusted to 3 mg/mL, respectively.

(5-1-3) Administration of the Agents for Measurement of Anti-Tumor Effect

On the eighth day after transplantation, mNS-mFa55 at a dose of 1 mg/kg, 2 mg/kg, 4 mg/kg, and 8 mg/kg and SW1208-mFa55 at a dose of 30 mg/kg were respectively administered to mice. The prepared administration solution was administered at a volume of 20 mL/kg through the tail vein.

Table 5 shows the details of the treatment with the agents for measurement of anti-tumor effect.

TABLE 5

| Group | Heads | Drug | Dose | Administration route | Administration date |
|---|---|---|---|---|---|
| 1 | 4 | Vehicle | — | Tail Vein | 8th day after transplantation |
| 2 | 4 | mNS-mFa55 | 1 | Tail Vein | 8th day after transplantation |
| 3 | 4 | mNS-mFa55 | 2 | Tail Vein | 8th day after transplantation |
| 4 | 4 | mNS-mFa55 | 4 | Tail Vein | 8th day after transplantation |
| 5 | 4 | mNS-mFa55 | 8 | Tail Vein | 8th day after transplantation |
| 6 | 4 | SW1208-mFa55 | 30 | Tail Vein | 8th day after transplantation |

(5-1-5) Assessment of Anti-Tumor Effect

The anti-tumor effect was assessed by the tumor volume calculated by the calculation formula provided in Example 5-1-1.

The tumor growth inhibition (TGI) value was calculated by the following calculation formula:

TGI (%)=(1−([the average value of the tumor volume in the tested group at the time of measurement]−[the average value of the tumor volume in the tested group at the time of the initial administration])/([the average value of the tumor volume in the control group at the time of measurement]−[the average value of the tumor volume in the control group at the time of the initial administration]))*100

Figure 5:
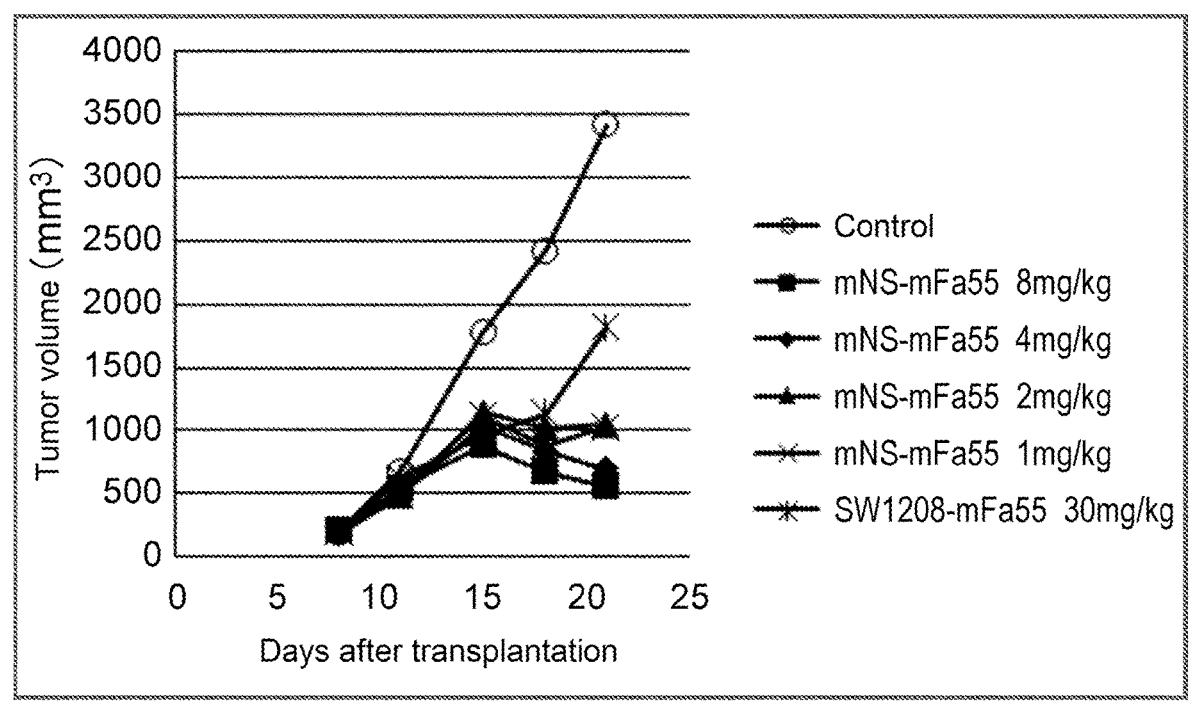
FIG. 5 shows the anti-tumor effect of anti-CTLA-4 antibodies mNS-mFa55 (control antibody) and SW1208-mFa55 (switch antibody) in a mouse model transplanted with the CT26 cell line (colon cancer) as described in Example 5-1-5. Through the tail vein, the control antibody was administered at 1 mg/kg, 2 mg/kg, 4 mg/kg, and 8 mg/kg, while the switch antibody was administered at 30 mg/kg. Each point represents the average value of the tumor volume of a group (n=4).

In consequence, the drug efficacy of TGI=50% or more was shown by mNS-mFa55 at a dose of 1, 2, 4, and 8 mg/kg and SW1208-mFa55 at a dose of 30 mg/kg on the 13th day after administration (FIG. 5).

(5-2) Assessment of Drug Efficacy of an Anti-CTLA4 Switch Antibody in a Syngeneic Tumor Cell Transplant Model (Bladder Cancer Model) Using Wild-Type Mice (5-2-1) the Cell Line and Production of a Syngeneic Tumor Line Transplant Mouse Model Mouse bladder cancer line MBT2 cells were purchased from JCRB Cell Bank and used in the experiment. MBT2 cells were maintained and passaged in the E-MEM medium (SIGMA) containing 10% FBS (SIGMA). The used mice were C3H/HeN (7-week-old, female) purchased from CHARLES RIVER LABORATORIES JAPAN, INC.

The volume of transplanted tumor was calculated by the following formula:

Tumor volume=long diameter×short diameter×short diameter/2

(5-2-2) Preparation of Agents for Administration

The anti-mouse CTLA4 control antibody (mNS-mFa55) prepared in Reference Example 3-4 and the anti-CTLA4 switch antibody (SW1208-mFa55) were administered to the MBT2 cell transplant model as the agents for administration. With His-buffer (20 mM His-HCl and 150 mM NaCl, pH 6.0), mNS-mFa55 was adjusted to 0.1 mg/mL and SW1208-mFa55 was adjusted to 3 mg/mL, respectively.

(5-2-3) Administration of the Agents for Measurement of Anti-Tumor Effect

On the eighth day after transplantation, mNS-mFa55 at a dose of 1 mg/kg and SW1208-mFa55 at a dose of 30 mg/kg were respectively administered to mice. The prepared administration solution was administered at a volume of 20 mL/kg through the tail vein.

Table 6 shows the details of the treatment with the agents for measurement of anti-tumor effect.

TABLE 6

| Group | Heads | Drug | Dose | Administration route | Administration date |
|---|---|---|---|---|---|
| 1 | 4 | Vehicle | — | Tail Vein | 8th day after transplantation |
| 2 | 4 | mNS-mFa55 | 1 | Tail Vein | 8th day after transplantation |
| 3 | 4 | SW1208-mFa55 | 30 | Tail Vein | 8th day after transplanation |

(5-2-4) Assessment of Anti-Tumor Effect

The anti-tumor effect was assessed by the tumor volume calculated by the calculation formula provided in Example 5-2-1.

The tumor growth inhibition (TGI) value was calculated by the following calculation formula:

TGI (%)=(1−([the average value of the tumor volume in the tested group at the time of measurement]−[the average value of the tumor volume in the tested group at the time of the initial administration])/([the average value of the tumor volume in the control group at the time of measurement]−[the average value of the tumor volume in the control group at the time of the initial administration]))*100

Figure 6:
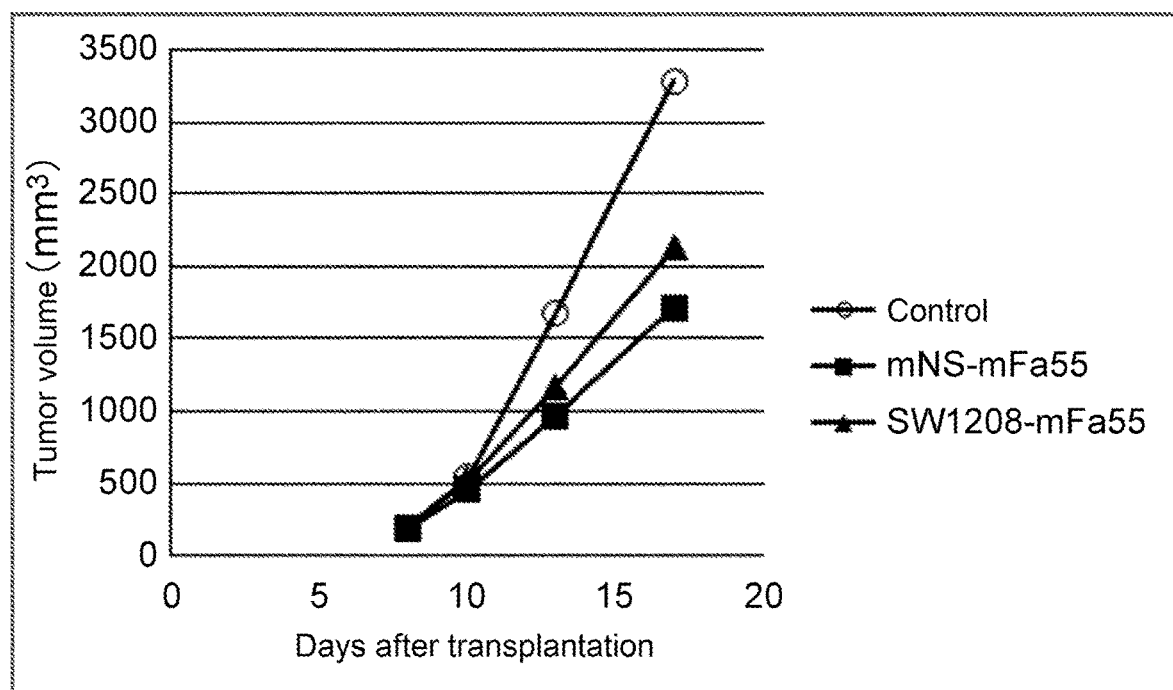
FIG. 6 shows the anti-tumor effect of anti-CTLA-4 antibodies mNS-mFa55 (control antibody) and SW1208-mFa55 (switch antibody) in a mouse model transplanted with the MBT2 cell line (bladder cancer) as described in Example 5-2-4. Through the tail vein, the control antibody was administered at 1 mg/kg, while the switch antibody was administered at 30 mg/kg. Each point represents the average value of the tumor volume of a group (n=5).

In consequence, the drug efficacy of TGI=51% and 37% was shown by mNS-mFa55 at a dose of 1 mg/kg and SW1208-mFa55 at a dose of 30 mg/kg on the ninth day after administration (FIG. 6).

(5-3) Assessment of Drug Efficacy of Anti-CTLA4 Switch Antibodies in a Syngeneic Tumor Cell Transplant Model (Colon Cancer Model) Using Human CTLA4 Knock-In, Human CD3 Transgenic Mice (5-3-1) the Cell Line Mouse colon cancer line Colon 38 cells were donated from Japanese Foundation For Cancer Research under the agreement of NCI (National Cancer Institute) and used in the experiment. Colon 38 cells were maintained and passaged in the RPMI1640 medium (SIGMA) containing 10% FBS (SIGMA).

(5-3-2) Production of a Syngeneic Tumor Line Transplant Mouse Model

Human CTLA4 KI, human CD3 EDG replaced mice (hCTLA4 KI hCD3 EDG replaced mice) (12-week-old, male), which are a hybrid strain of human CTLA4 knock-in mice (Blood (2005) 106 (9): 3127-3133) and in-house-produced human CD3 EDG replaced mice (Sci Rep (2017) 7:45839), were used.

The volume of transplanted tumor was calculated by the following formula:

Tumor volume=long diameter×short diameter×short diameter/2

(5-3-3) Preparation of Agents for Administration

The anti-CTLA4 switch antibody (SW1610-mFa55 or SW1612-mFa55) prepared in Reference Example 5-2 or the anti-human CTLA4 control antibody (hNS-mFa55) prepared in Reference Example 4-2 was administered to the Colon 38 cell transplant model as the agent for administration. With His-buffer (150 mM NaCl/20 mM His-HCl buffer, pH 6.0), the switch antibodies (SW1610-mFa55 and SW1612-mFa55) and the control antibody were adjusted to 0.03, 0.1, and 1 mg/mL, 0.03, 0.1, and 1 mg/mL, and 0.01, 0.03, and 0.1 mg/mL, respectively.

(5-3-4) Administration of the Agents for Measurement of Anti-Tumor Effect

On the 10th day after transplantation, SW1610-mFa55 at a dose of 0.3 mg/kg, 1 mg/kg, and 10 mg/kg, SW1612-mFa55 at a dose of 0.3 mg/kg, 1 mg/kg, and 10 mg/kg, and hNS-mFa55 at a dose of 0.1 mg/kg, 0.3 mg/kg, and 1 mg/kg were administered to mice through the tail vein. Table 7 shows the details of the treatment with the agents for measurement of anti-tumor effect.

TABLE 7

| Group | Heads | Drug | Dose | Administration route | Administration date |
|---|---|---|---|---|---|
| 1 | 4 | His-buffer | — | Tail Vein | 10th day after transplantation |
| 2 | 4 | hNS-mFa55 | 0.1 | Tail Vein | 10th day after transplantation |
| 3 | 4 | hNS-mFa55 | 0.3 | Tail Vein | 10th day after transplantation |
| 4 | 4 | hNS-mFa55 | 1 | Tail Vein | 10th day after transplantation |
| 5 | 4 | SW1610-mFa55 | 0.3 | Tail Vein | 10th day after transplantation |
| 6 | 4 | SW1610-mFa55 | 1 | Tail Vein | 10th day after transplantation |
| 7 | 4 | SW1610-mFa55 | 10 | Tail Vein | 10th day after transplantation |
| 8 | 4 | SW1612-mFa55 | 0.3 | Tail Vein | 10th day after transplantation |
| 9 | 4 | SW1612-mFa55 | 1 | Tail Vein | 10th day after transplantation |
| 10 | 4 | SW1612-mFa55 | 10 | Tail Vein | 10th day after transplantation |

(5-3-5) Assessment of Anti-Tumor Effect

The anti-tumor effect was assessed by the tumor volume calculated by the calculation formula provided in Example 5-3-2.

The TGI (tumor growth inhibition) value was calculated by the following calculation formula:

TGI=(1−([the average value of the tumor volume in the tested group at the time of measurement]−[the average value of the tumor volume at a time before administration of the antibody])/([the average value of the tumor volume in the control group at the time of measurement]−[the average value of the tumor volume at a time before administration of the antibody]))*100

Figure 7:
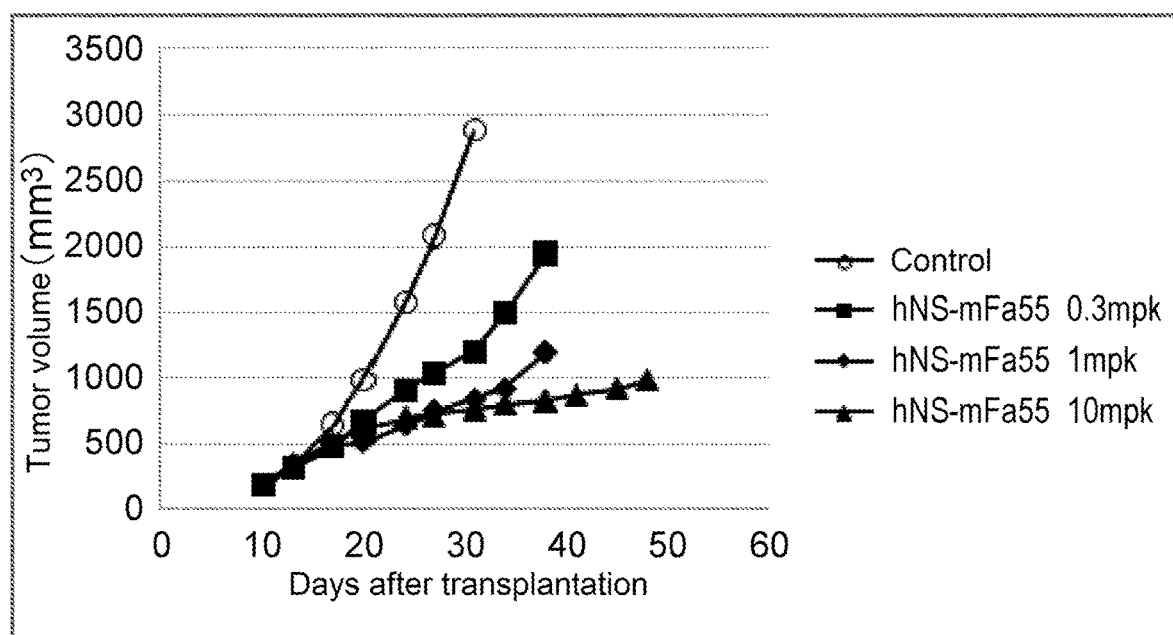
FIG. 7 shows the anti-tumor effect of anti-CTLA-4 antibody hNS-mFa55 (control antibody) in a mouse model transplanted with the Colon38 cell line (colon cancer) as described in Example 5-3-5. Through the tail vein, the control antibody was administered at 0.3 mg/kg, 1 mg/kg, and 10 mg/kg. Each point represents the average value of the tumor volume of a group (n=4).
Figure 8:
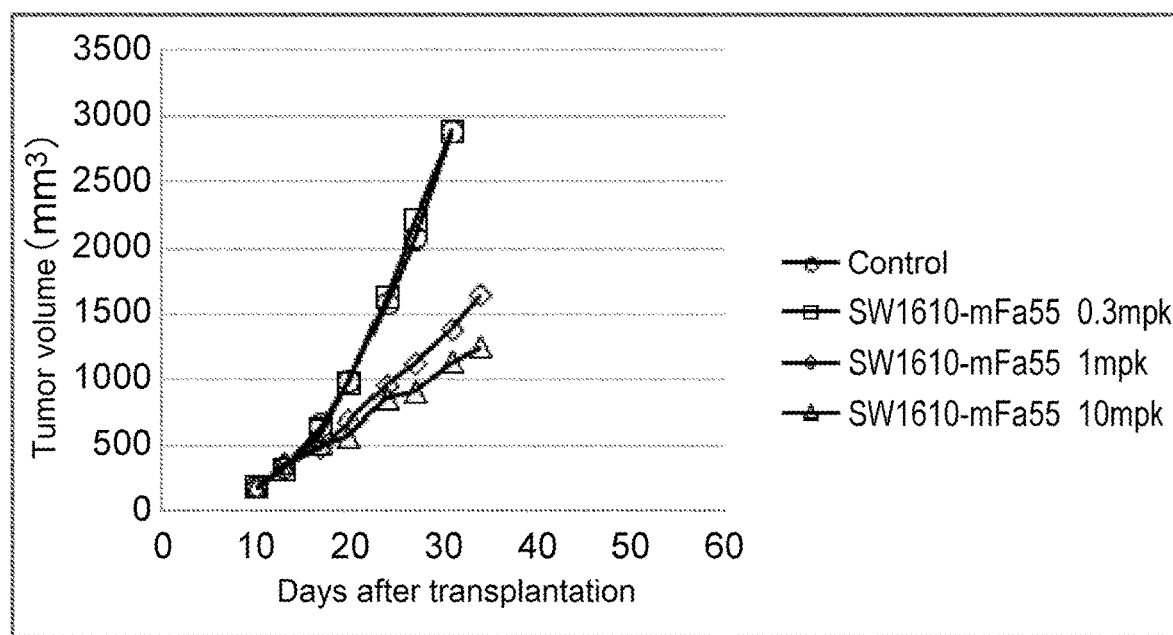
FIG. 8 shows the anti-tumor effect of anti-CTLA-4 antibody SW1610-mFa55 (switch antibody) in a mouse model transplanted with the Colon38 cell line (colon cancer) as described in Example 5-3-5. Through the tail vein, the switch antibody was administered at 0.3 mg/kg, 1 mg/kg, and 10 mg/kg. Each point represents the average value of the tumor volume of a group (n=4).
Figure 9:
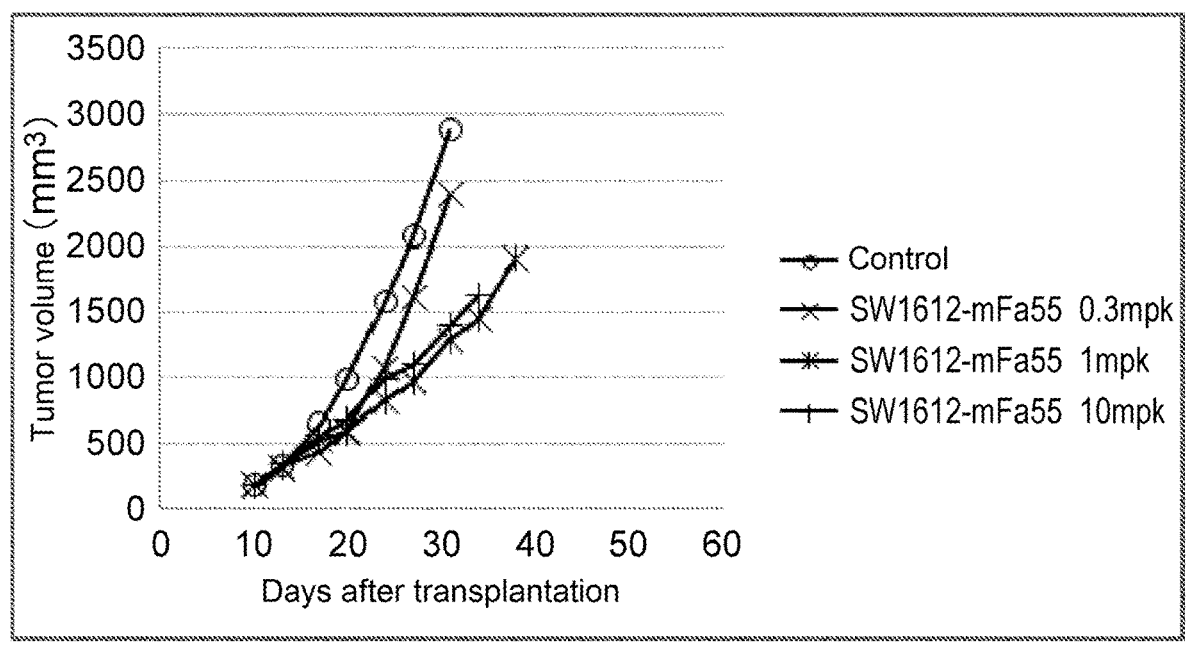
FIG. 9 shows the anti-tumor effect of anti-CTLA-4 antibody SW1612-mFa55 (switch antibody) in a mouse model transplanted with the Colon38 cell line (colon cancer) as described in Example 5-3-5. Through the tail vein, the switch antibody was administered at 0.3 mg/kg, 1 mg/kg, and 10 mg/kg. Each point represents the average value of the tumor volume of a group (n=4).

In consequence, the drug efficacy of TGI=55% or more was shown by hNS-mFa55 at a dose of 0.3 mg/kg or more and both SW1610-mFa55 and SW1612-mFa55 at a dose of 1 mg/kg or more on the 21st day after administration. The results are shown in FIG. 7 for hMS-mFa55, FIG. 8 for SW1610-mFa55, and FIG. 9 for SW1612-mFa55, respectively.

(5-4) Assessment of Drug Efficacy of Anti-CTLA4 Switch Antibodies in a Syngeneic Tumor Cell Transplant Model (Breast Cancer Model) Using Human CTLA4 Knock-In, Human CD3 Transgenic Mice (5-4-1) the Cell Line Mouse breast cancer line A755 cells were donated from Dr. Iigo at National Cancer Center Japan and used in the experiment. A755 cells were maintained and passaged by in vivo passage.

(5-4-2) Production of a Syngeneic Tumor Line Transplant Mouse Model

Human CTLA4 KI, human CD3 EDG replaced mice (hCTLA4 KI hCD3 EDG replaced mice) (19-week-old, female), which are a hybrid strain of human CTLA4 knock-in mice (Blood (2005) 106 (9): 3127-3133) and in-house-produced human CD3 EDG replaced mice (Sci Rep (2017) 7:45839), were used.

The volume of transplanted tumor was calculated by the following formula:

Tumor volume=long diameter×short diameter×short diameter/2

(5-4-3) Preparation of Agents for Administration

The anti-CTLA4 switch antibody (SW1610-mFa55 or SW1389-mFa55) prepared in Reference Example 3-4 and Reference Example 5-2 or the anti-human CTLA4 control antibody (hNS-mFa55) prepared in Reference Example 4-2 was administered to the A755 cell transplant model as the agent for administration. With His-buffer (150 mM NaCl/20 mM His-HCl buffer, pH 6.0), the switch antibodies (SW1610-mFa55 and SW1389-mFa55) and the control antibody were adjusted to 3 mg/mL, 3 mg/mL, and 1 mg/mL, respectively.

(5-4-4) Administration of the Agents for Measurement of Anti-Tumor Effect

On the seventh day after transplantation, SW1610-mFa55 at a dose of 30 mg/kg, SW1389-mFa55 at a dose of 10 mg/kg, and hNS-mFa55 at a dose of 10 mg/kg were administered to mice through the tail vein. Table 8 shows the details of the treatment with the agents for measurement of anti-tumor effect.

TABLE 8

| Group | Heads | Drug | Dose | Administration route | Administration date |
|---|---|---|---|---|---|
| 1 | 4 | Vehicle | — | Tail Vein | 7th day after transplantation |
| 2 | 4 | SW1389-mFa55 | 30 | Tail Vein | 7th day after transplantation |
| 3 | 4 | SW1610-mFa55 | 30 | Tail Vein | 7th day after transplanation |
| 4 | 4 | hNS-mFa55 | 10 | Tail Vein | 7th day after transplantation |

(5-4-5) Assessment of Anti-Tumor Effect

The anti-tumor effect was assessed by the tumor volume calculated by the calculation formula provided in Example 5-4-2.

The TGI (tumor growth inhibition) value was calculated by the following calculation formula:

TGI=(1−([the average value of the tumor volume in the tested group at the time of measurement]−[the average value of the tumor volume at a time before administration of the antibody])/([the average value of the tumor volume in the control group at the time of measurement]−[the average value of the tumor volume at a time before administration of the antibody]))*100

Figure 10:
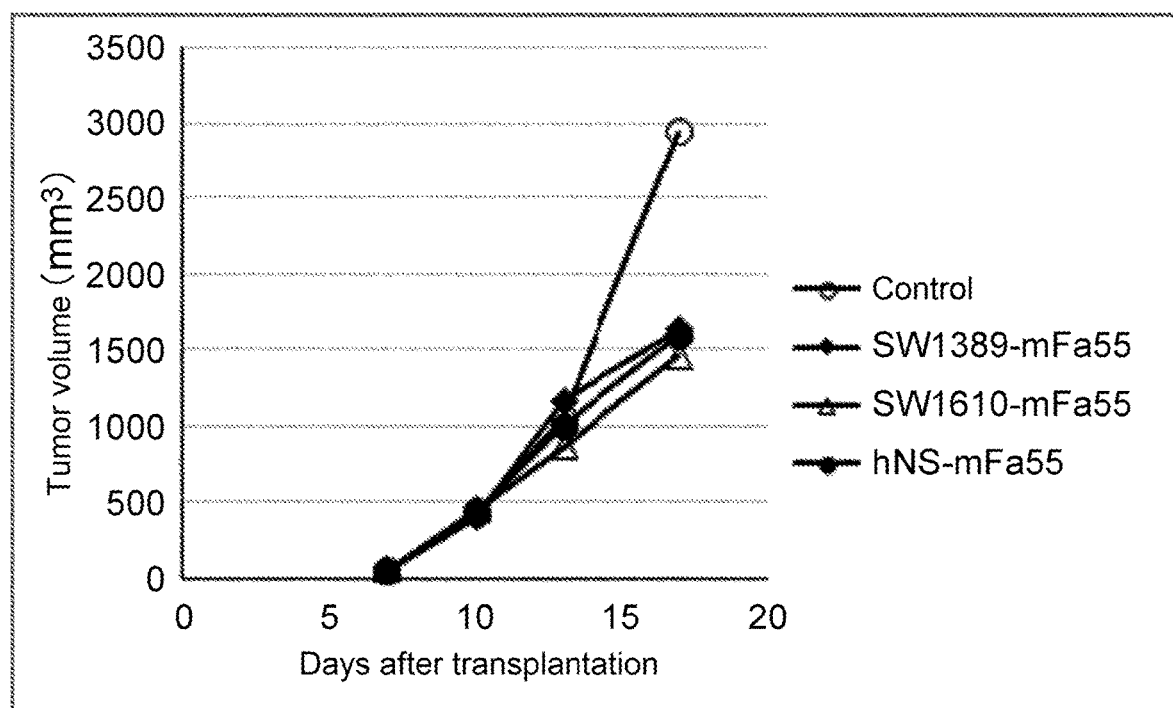
FIG. 10 shows the anti-tumor effect of anti-CTLA-4 antibodies hNS-mFa55 (control antibody) and SW1610-mFa55 and SW1389-mFa55 (switch antibodies) in a mouse model transplanted with the A755 cell line (breast cancer) as described in Example 5-4-5. Through the tail vein, the control antibody was administered at 10 mg/kg, while the switch antibodies were administered at 30 mg/kg each. Each point represents the average value of the tumor volume of a group (n=4).

In consequence, the drug efficacy of TGI=46% or more was shown by hNS-mFa55 at a dose of 10 mg/kg, SW1610-mFa55 at a dose of 30 mg/kg, and SW1389-mFa55 at a dose of 30 mg/kg, respectively, on the 10th day after administration (FIG. 10).

(5-5) Assessment of Drug Efficacy of Anti-CTLA4 Switch Antibodies in a Syngeneic Tumor Cell Transplant Model (Melanoma Model) Using Human CTLA4 Knock-In, Human CD3 Transgenic Mice (5-5-1) the Cell Line Mouse melanoma line B16F1 was purchased from ATCC (CRL-6323) and transfected with the chicken Ovalbumin (OVA, SEQ ID NO: 382) gene to constitutively express it. The cells were cloned and used in the experiment. B16F1/OVA cells were maintained and passaged in the D-MEM (high glucose) medium (SIGMA) containing 10% FBS (SIGMA) and 0.5 mg/mL G-418 (NACALAI TESQUE, INC.).

(5-5-2) Production of a Syngeneic Tumor Line Transplant Mouse Model

Human CTLA4 KI, human CD3 EDG replaced mice (hCTLA4 KI hCD3 EDG replaced mice) (17-week-old, female), which are a hybrid strain of human CTLA4 knock-in mice (Blood (2005) 106 (9): 3127-3133) and in-house-produced human CD3 EDG replaced mice (Sci Rep (2017) 7:45839), were used.

The volume of transplanted tumor was calculated by the following formula:

Tumor volume=long diameter×short diameter×short diameter/2

(5-5-3) Preparation of Agents for Administration

The anti-CTLA4 switch antibody (SW1610-mFa55 or SW1389-mFa55) prepared in Reference Example 3-4 and Reference Example 5-2 or the anti-human CTLA4 control antibody (hNS-mFa55) prepared in Reference Example 4-2 was administered to the B16F1/OVA cell transplant model as the agent for administration. With His-buffer (150 mM NaCl/20 mM His-HCl buffer, pH 6.0), the switch antibodies (SW1610-mFa55 and SW1389-mFa55) and the control antibody were adjusted to 10 mg/mL, 10 mg/mL, and 1 mg/mL, respectively.

(5-5-4) Administration of the Agents for Measurement of Anti-Tumor Effect

On the seventh day after transplantation, SW1610-mFa55 at a dose of 100 mg/kg, SW1389-mFa55 at a dose of 100 mg/kg, and hNS-mFa55 at a dose of 10 mg/kg were administered to mice through the tail vein. Table 9 shows the details of the treatment with the agents for measurement of anti-tumor effect.

TABLE 9

| Group | Heads | Drug | Dose | Administration route | Administration date |
|---|---|---|---|---|---|
| 1 | 4 | Vehicle | — | Tail Vein | 7th day after transplantation |
| 2 | 4 | SW1389-mFa55 | 100 | Tail Vein | 7th day after transplantation |
| 3 | 4 | SW1610-mFa55 | 100 | Tail Vein | 7th day after transplantation |
| 4 | 4 | hNS-mFa55 | 10 | Tail Vein | 7th day after transplantation |

(5-5-5) Assessment of Anti-Tumor Effect

The anti-tumor effect was assessed by the tumor volume calculated by the calculation formula provided in Example 5-5-2.

The TGI (tumor growth inhibition) value was calculated by the following calculation formula:

TGI=(1−([the average value of the tumor volume in the tested group at the time of measurement]−[the average value of the tumor volume at a time before administration of the antibody])/([the average value of the tumor volume in the control group at the time of measurement]−[the average value of the tumor volume at a time before administration of the antibody]))*100

Figure 11:
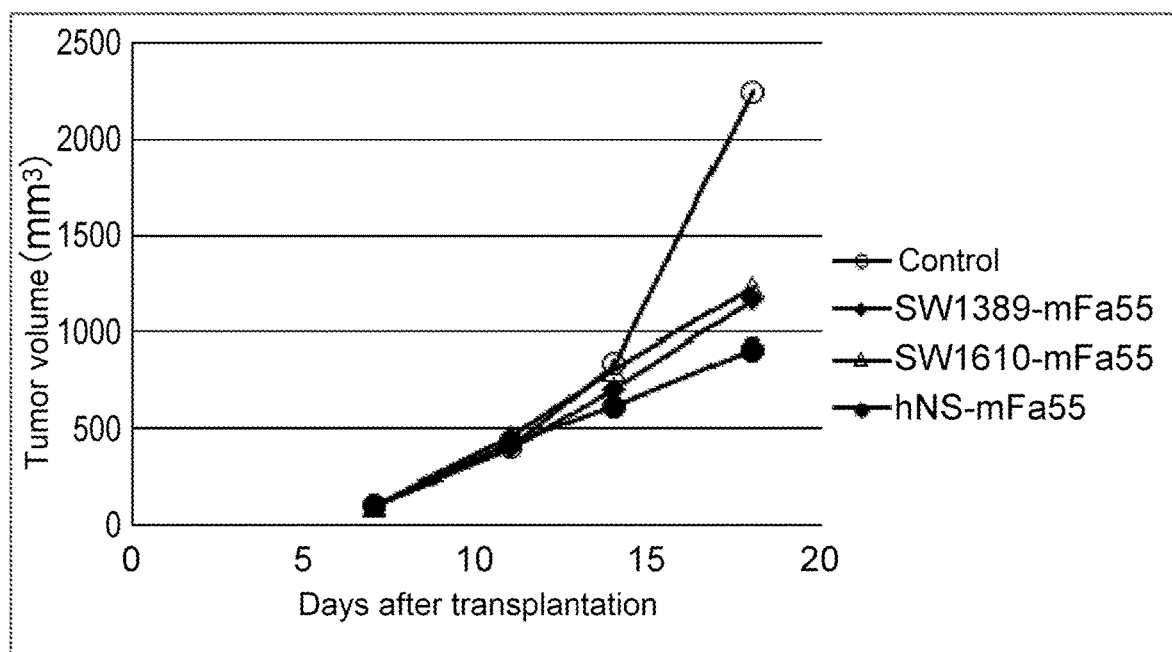
FIG. 11 shows the anti-tumor effect of anti-CTLA-4 antibodies hNS-mFa55 (control antibody) and SW1610-mFa55 and SW1389-mFa55 (switch antibodies) in a mouse model transplanted with the B16F1/OVA cell line (melanoma) as described in Example 5-5-5. Through the tail vein, the control antibody was administered at 10 mg/kg, while the switch antibodies were administered at 100 mg/kg each. Each point represents the average value of the tumor volume of a group (n=4).

In consequence, the drug efficacy of TGI=47% or more was shown by hNS-mFa55 at a dose of 10 mg/kg, SW1610- mFa55 at a dose of 30 mg/kg, and SW1389-mFa55 at a dose of 30 mg/kg on the 11th day after administration (FIG. 11).

Example 6

Figure 12:
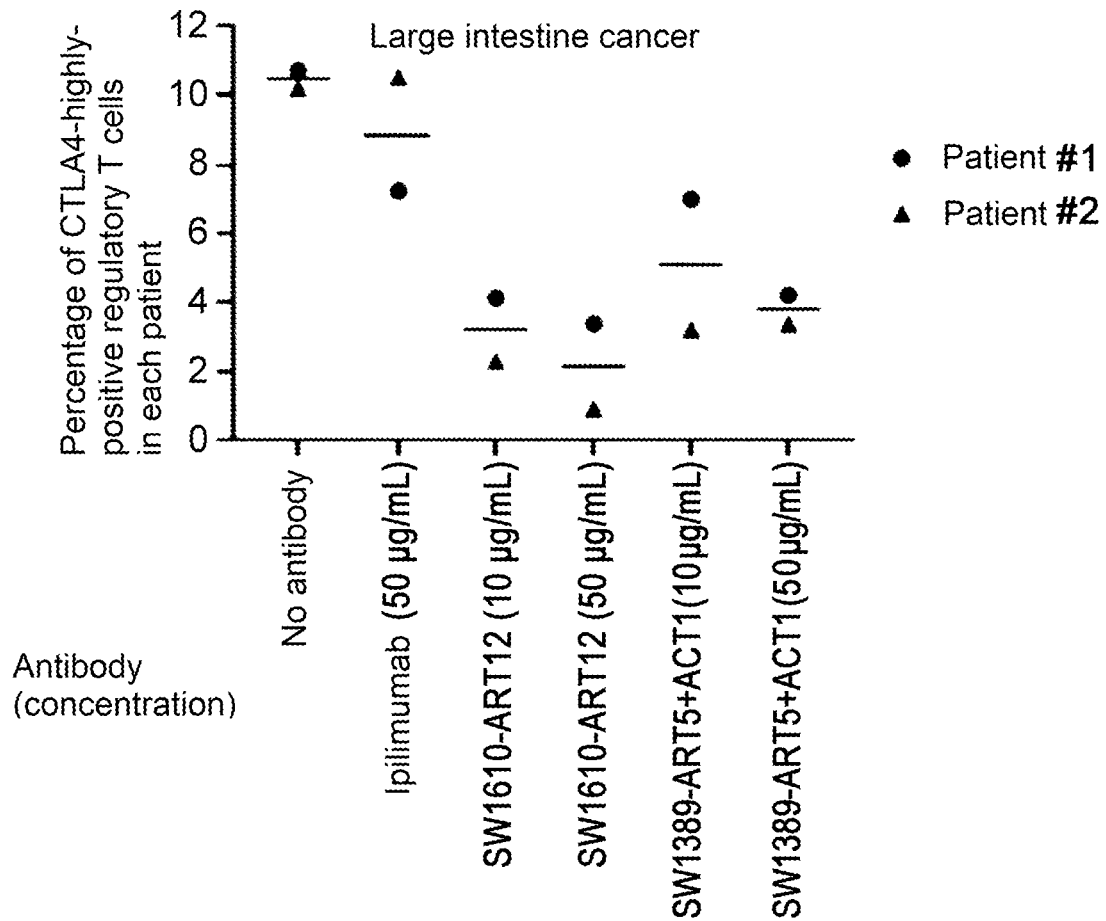
FIG. 12 shows the Treg depletion activity of Ipilimumab and SW1610-ART12 and SW1389-ART5+ACT1 (switch antibodies) on PBMCs derived from patients with large intestine cancer as described in Example 6. Each of the antibodies was used at 10 μg/mL or 50 μg/mL. Each point represents a sample from a distinct patient, and the horizontal line shows the average value.
Figure 13:
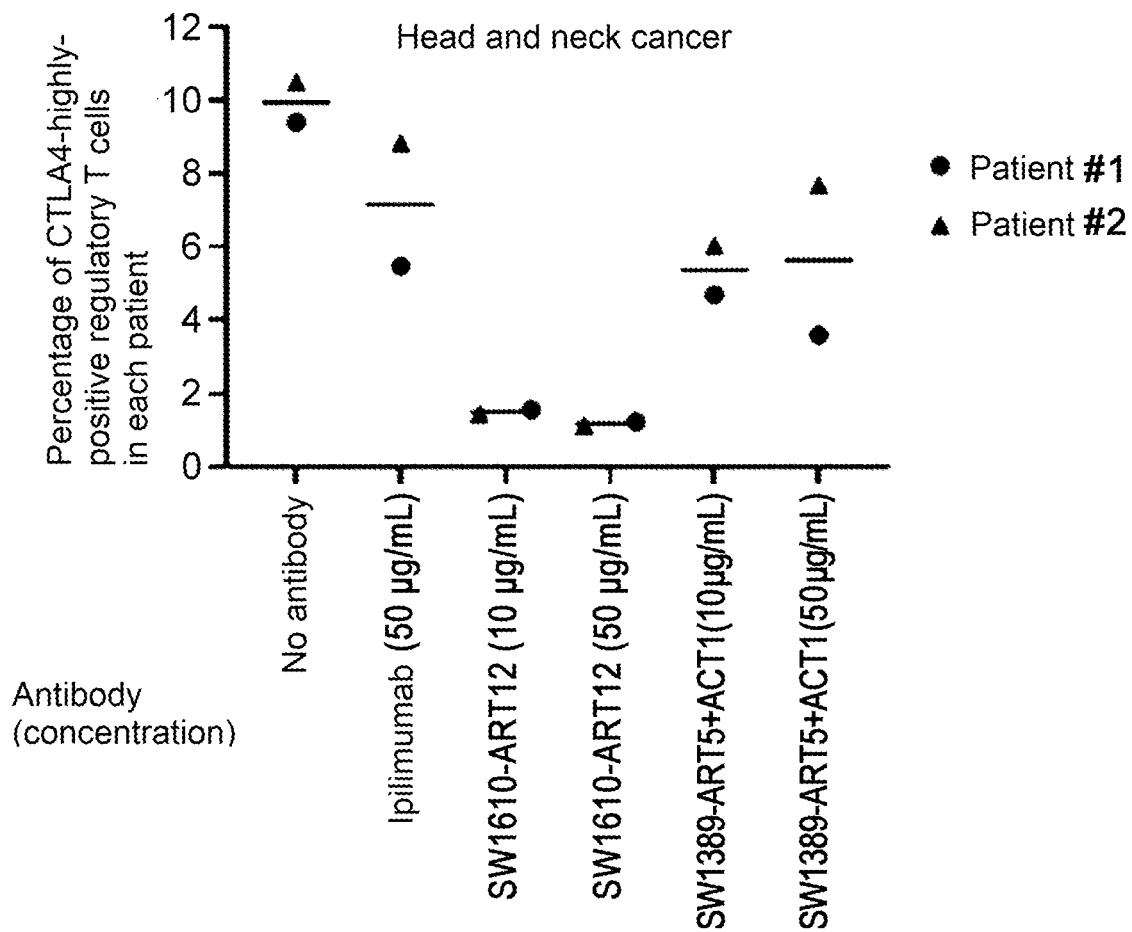
FIG. 13 shows the Treg depletion activity of Ipilimumab and SW1610-ART12 and SW1389-ART5+ACT1 (switch antibodies) on PBMCs derived from patients with head and neck cancer as described in Example 6. Each of the antibodies was used at 10 μg/mL or 50 μg/mL. Each point represents a sample from a distinct patient, and the horizontal line shows the average value.
Figure 14:
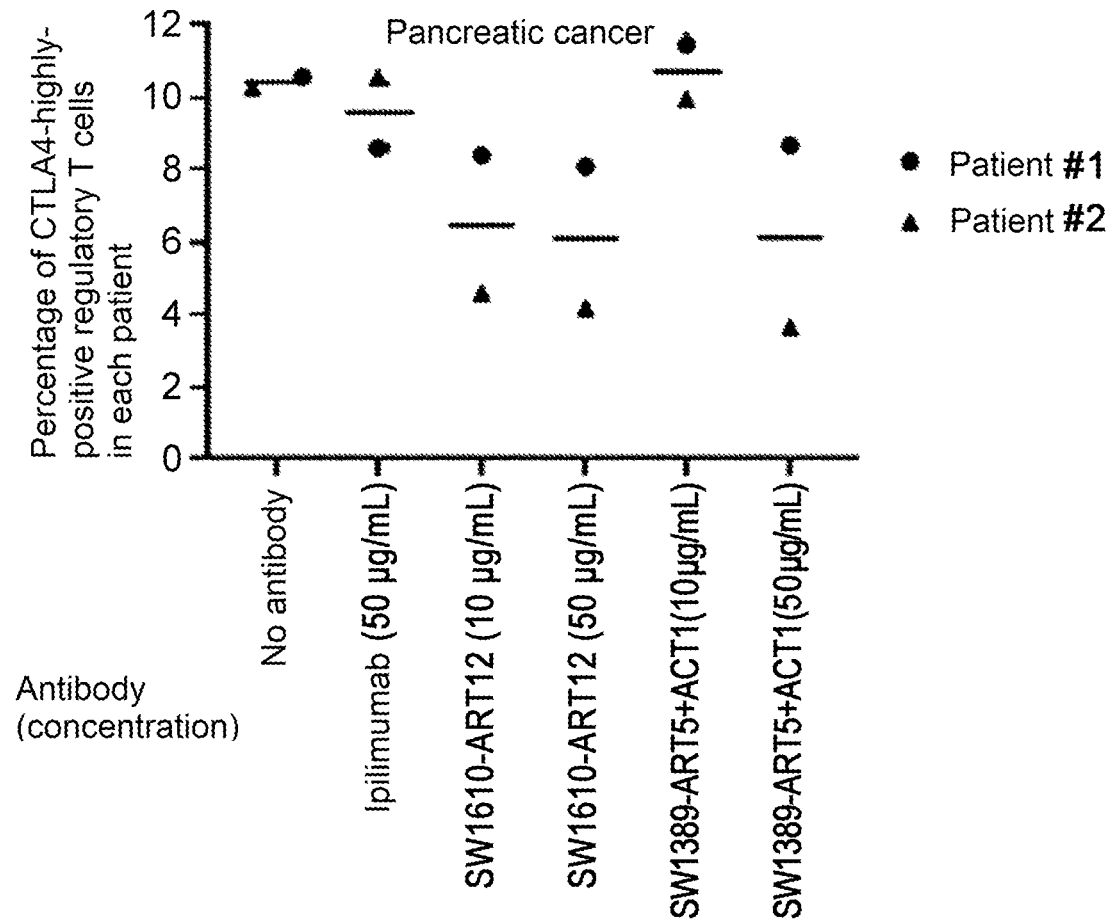
FIG. 14 shows the Treg depletion activity of Ipilimumab and SW1610-ART12 and SW1389-ART5+ACT1 (switch antibodies) on PBMCs derived from patients with pancreatic cancer as described in Example 6. Each of the antibodies was used at 10 μg/mL or 50 μg/mL. Each point represents a sample from a distinct patient, and the horizontal line shows the average value.
Figure 15:
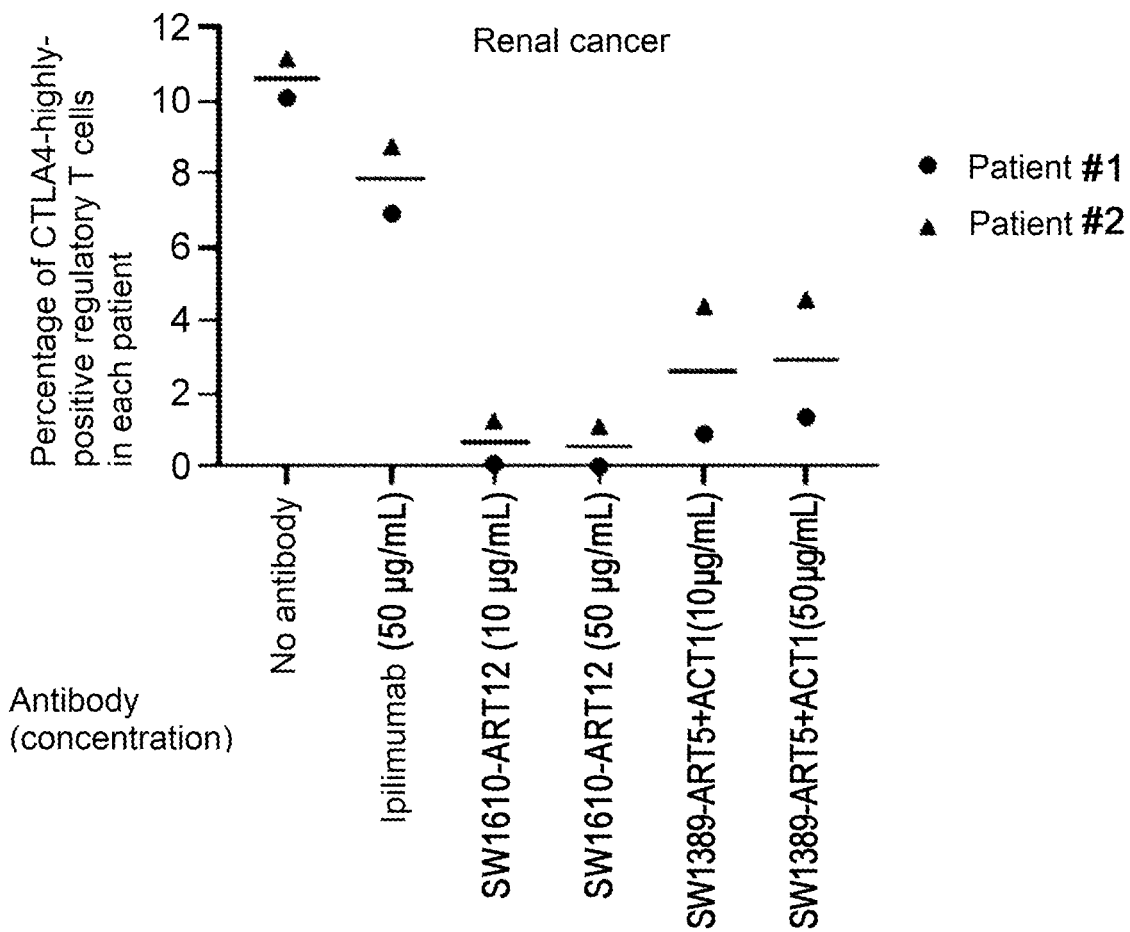
FIG. 15 shows the Treg depletion activity of Ipilimumab and SW1610-ART12 and SW1389-ART5+ACT1 (switch antibodies) on PBMCs derived from patients with renal cancer as described in Example 6. Each of the antibodies was used at 10 μg/mL or 50 μg/mL. Each point represents a sample from a distinct patient, and the horizontal line shows the average value.
Figure 16:
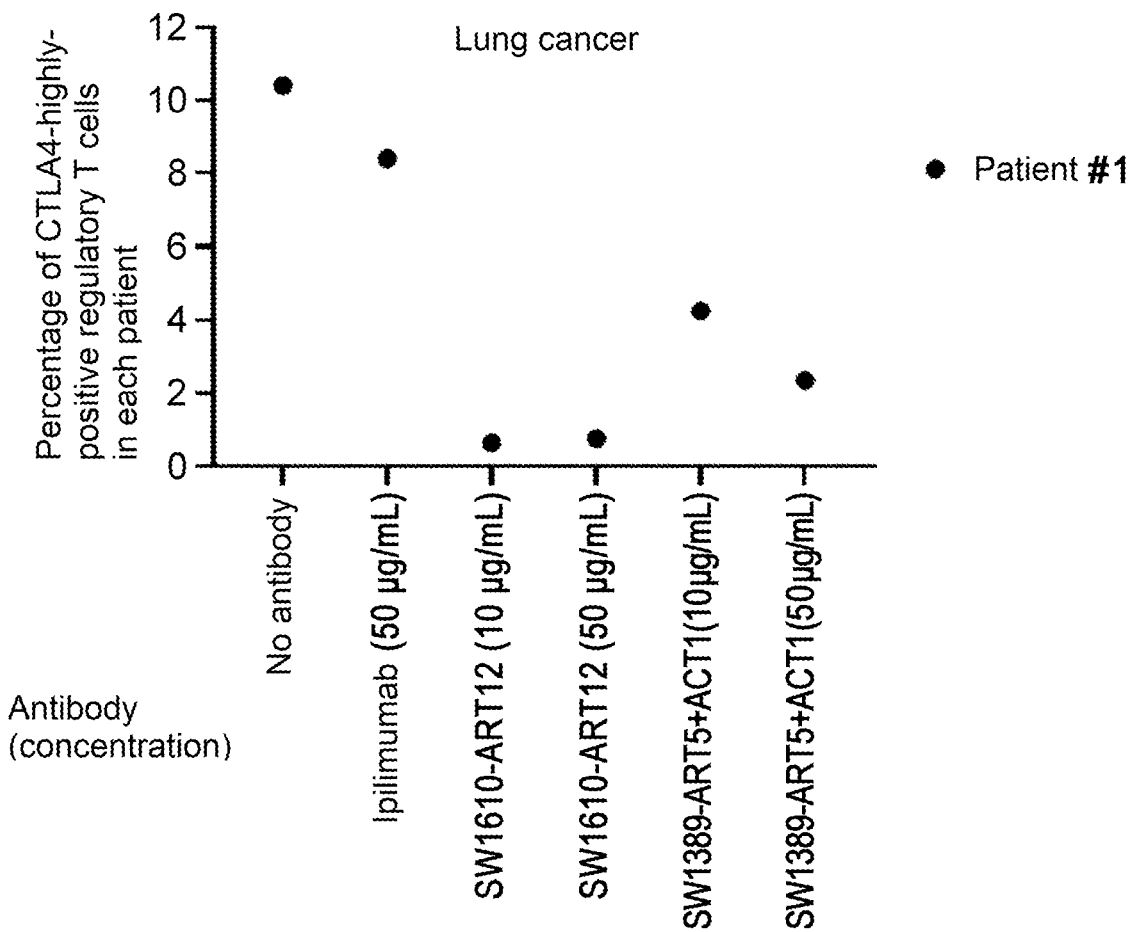
FIG. 16 shows the Treg depletion activity of Ipilimumab and SW1610-ART12 and SW1389-ART5+ACT1 (switch antibodies) on PBMCs derived from a patient with lung cancer as described in Example 6. Each of the antibodies was used at 10 μg/mL or 50 μg/mL.

Assessment of the In Vitro Treg Depletion Activity of Anti-CTLA4 Switch Antibodies with a Modified Fc Region Using Human Patient PBMCs In vitro cytotoxic activity of the anti-CTLA4 switch antibodies with a modified Fc produced in Example 4 (SW1610-ART12 and SW1389-ART5+ACT1) or Ipilimumab against CTLA4-positive regulatory T cells (CD3+ CD4+ FoxP3high CD45RA-CTLA4high) was assessed. PBMCs (Peripheral Blood Mononuclear Cells, Discovery Life Sciences) derived from cancer patients were freeze-thawed, suspended in 200 U/ml interleukin 2 (IL-2)/RPMI/ 10% FBS at a cell density of $5 \times 10^6$ cells/mL, and cultured at 37° C. for four days in a 5% $CO_2$ incubator. Four days later, the cells were harvested, resuspended in RPMI/10% FBS, and then seeded at 50 μL in each well of 96-well V-shape bottom plates ($3-10 \times 10^5$ cells/well). The anti-KLH antibody (KLH-G1m) solution adjusted to 4 mg/ml with RPMI/10% FBS was added at 50 μL in each well, and subsequently, the antibody solution adjusted to each concentration (0, 40, and 200 μg/mL) with RPMI/10% FBS was added at 50 μL in each well of the 96-well V-shape bottom plates. An ATP solution adjusted to 400 μM with RPMI/10% FBS was further added at 50 μL each, and the cells well suspended, and left to stand at 37° C. for six hours in a $CO_2$ incubator (An ATP solution adjusted to 4000 μM was added at 5 μL each, twice in total at an interval of two hours). After six hours, PBMCs were collected, washed with auto MACS Rinsing Solution (Milteny), and then reacted with the following antibodies to analyze existing immune cell fractions by FACS analysis: a reagent to determine viability (Biolegend, Zombie NIR), anti-CD3 antibody (BD, clone: UCHT1), anti-CD4 antibody (BD, clone: RPA-T4), anti-CD45RA antibody (Biolegend, clone: HI100), anti-FoxP3 antibody (eBioscience, clone: 236A/E7), and anti-CTLA4 antibody (BD, clone: BNI3). The FACS analysis was performed with BD FACSCelesta (BD). Of regulatory T cells corresponding to the CD45RA-FoxP3high fraction in living cells at each antibody concentration, approximately 10% with the highest intensity of CTLA4 expression were gated and used as an index to assess cytotoxic activity of each antibody. The results obtained are shown in FIG. 12 (patients with large intestine cancer), FIG. 13 (patients with head and neck cancer), FIG. 14 (patients with pancreatic cancer), FIG. 15 (patients with renal cancer), and FIG. 16 (a patient with lung cancer).

From these results, it was confirmed that the anti-CTLA4 switch antibodies with a modified Fc have cytotoxic activity against CTLA4-highly-expressing regulatory T cells in the presence of ATP in PBMCs derived from cancer patients.

Example 7

Assessment of In Vivo Efficacy of Combined Use of Anti-CTLA4 Switch Antibodies and Various Chemotherapeutic Agents in Mouse Models Transplanted with Various Syngeneic Tumor Lines (7-1) Assessment of Efficacy of Combined Use of an Anti-CTLA4 Switch Antibody and Various Chemotherapeutic Agents in a Syngeneic Tumor Cell Transplant Model (Colon Cancer Model) Using Wild-Type Mice (7-1-1) the Cell Line and Production of a Syngeneic Tumor Line Transplant Mouse Model Mouse colon cancer line CT26. WT cells were purchased from ATCC and used in the experiment. CT26.WT cells were maintained and passaged in the RPMI1640 medium (NACALAI TESQUE, INC.) containing 10% FBS (CORNING), 1 mM Sodium Pyruvate (GIBCO), 10 mM HEPES (SIGMA), and 0.45% D-glucose (SIGMA). The used mice were BALB/c mice (7-week-old, female) purchased from JACKSON LABORATORY JAPAN, INC.

The volume of transplanted tumor was calculated by the following formula:

Tumor volume=long diameter×short diameter×short diameter/2

(7-1-2) Preparation of Agents for Administration

The anti-mouse CTLA4 switch antibody (SW1208-mFa55) prepared in Reference Example 3-4 and carboplatin, paclitaxel, or gemcitabine as a chemotherapeutic agent were administered to the CT26 cell transplant model as the agents for administration. SW1208-mFa55 was prepared at 10 mg/mL using D-PBS. Carboplatin was prepared at 8 mg/mL using physiological saline, gemcitabine was prepared at 12 mg/mL using physiological saline, and paclitaxel was prepared at 2 mg/mL using ethanol, Cremophor EL, and physiological saline (1:1:18).

(7-1-3) Administration of the Agents for Measurement of Anti-Tumor Effect

The chemotherapeutic agent was administered on the 9th day after transplantation, and SW1208-mFa55 was administered on the 10th day after transplantation. SW1208-mFa55 was administered at a dose of 100 mg/kg, carboplatin was administered at a dose of 80 mg/kg, gemcitabine was administered at a dose of 120 mg/kg, and paclitaxel was administered at a dose of 20 mg/kg, to the mice. The prepared administration solution was administered at a volume of 10 mL/kg through the tail vein.

Table 10 shows the details of the treatment with the agents for measurement of anti-tumor effect.

TABLE 10

(7-1-4) Assessment of anti-tumor effect

| Group | Heads | Drug 1 | Dose (mg/kg) | Administration date (after transplantation) | Drug 2 | Dose (mg/kg) | Administration date (after transplantation) |
|---|---|---|---|---|---|---|---|
| 1 | 5 | Vehicle | — | 10th day | — | — | 9th day |
| 2 | 5 | SW1208-mFa55 | 100 | 10th day | — | — | 9th day |
| 3 | 5 | — | — | 10th day | Carboplatin | 80 | 9th day |
| 4 | 5 | SW1208-mFa55 | 100 | 10th day | Carboplatin | 80 | 9th day |
| 5 | 5 | — | — | 10th day | Paclitaxel | 20 | 9th day |
| 6 | 5 | SW1208-mFa55 | 100 | 10th day | Paclitaxel | 20 | 9th day |

TABLE 10-continued (7-1-4) Assessment of anti-tumor effect

| Group | Heads | Drug 1 | Dose (mg/kg) | Administration date (after transplantation) | Drug 2 | Dose (mg/kg) | Administration date (after transplantation) |
|---|---|---|---|---|---|---|---|
| 7 | 5 | — | — | 10th day | Gemcitabine | 120 | 9th day |
| 8 | 5 | SW1208-mFa55 | 100 | 10th day | Gemcitabine | 120 | 9th day |

The anti-tumor effect was assessed by the tumor volume calculated by the calculation formula provided in Example 7-1-1.

The tumor growth inhibition (TGI) value was calculated by the following calculation formula:

TGI (%)=(1−([the average value of the tumor volume in the tested group at the time of measurement]−[the average value of the tumor volume in the tested group at the time of the initial administration])/([the average value of the tumor volume in the control group at the time of measurement]−[the average value of the tumor volume in the control group at the time of the initial administration]))*100

As a result, the combined therapies of 100 mg/kg SW1208-mFa55 with 80 mg/kg carboplatin, 120 mg/kg gemcitabine, and 20 mg/kg paclitaxel showed more potent anti-tumor effect than the monotherapies (Table 11).

TABLE 11

| Drugs | TGI (%) on the 9th day after start of administration |
|---|---|
| SW1208-mFa55 | 3 |
| Carboplatin | 46 |
| Carboplatin + SW1208-mFa55 Combination | 72 |
| Paclitaxel | 0 |
| Paclitaxel + SW1208-mFa55 Combination | 14 |
| Gemcitabine | 70 |
| Gemcitabine + SW1208-mFa55 Combination | 92 |

(7-2) Assessment of Efficacy of Combined Use of an Anti-CTLA4 Switch Antibody and Various Chemotherapeutic Agents in a Syngeneic Tumor Cell Transplant Model (Melanoma Model) Using Wild-Type Mice (7-2-1) the Cell Line and Production of a Syngeneic Tumor Line Transplant Mouse Model Mouse melanoma line B16F1 was purchased from ATCC (CRL-6323) and transfected with the chicken Ovalbumin (OVA, SEQ ID NO: 382) gene to constitutively express it. The cells were cloned and used in the experiment. B16F1/OVA cells were maintained and passaged in the D-MEM (high glucose) medium (NACALAI TESQUE, INC.) containing 10% FBS (CORNING) and 0.5 mg/mL G-418 (NACALAI TESQUE, INC.). The used mice were C57BL/6J (7-week-old, female) purchased from JACKSON LABORATORY JAPAN, INC.

The volume of transplanted tumor was calculated by the following formula:

Tumor volume=long diameter×short diameter×short diameter/2

(7-2-2) Preparation of Agents for Administration

The anti-mouse CTLA4 switch antibody (SW1208-mFa55) prepared in Reference Example 3-4 and carboplatin, paclitaxel, or gemcitabine as a chemotherapeutic agent were administered to the B16F1/OVA cell transplant model as the agents for administration. SW1208-mFa55 was prepared at 10 mg/mL using D-PBS. Carboplatin was prepared at 6 mg/mL using physiological saline, gemcitabine was prepared at 12 mg/mL using physiological saline, and paclitaxel was prepared at 2 mg/mL using ethanol, Cremophor EL, and physiological saline (1:1:18).

(7-2-3) Administration of the Agents for Measurement of Anti-Tumor Effect

The chemotherapeutic agent was administered on the 8th day after transplantation, and SW1208-mFa55 was administered on the 9th day after transplantation. SW1208-mFa55 was administered at a dose of 100 mg/kg, carboplatin was administered at a dose of 60 mg/kg, gemcitabine was administered at a dose of 120 mg/kg, and paclitaxel was administered at a dose of 20 mg/kg, to the mice. The prepared administration solution was administered at a volume of 10 mL/kg through the tail vein.

Table 12 shows the details of the treatment with the agents for measurement of anti-tumor effect.

TABLE 12

| Group | Heads | Drug 1 | Dose (mg/kg) | Administration date (after transplantation) | Drug 2 | Dose (mg/kg) | Administration date (after transplantation) |
|---|---|---|---|---|---|---|---|
| 1 | 5 | Vehicle | — | 9th day | — | — | 8th day |
| 2 | 5 | SW1208-mFa55 | 100 | 9th day | — | — | 8th day |
| 3 | 5 | — | — | 9th day | Carboplatin | 60 | 8th day |
| 4 | 5 | SW1208-mFa55 | 100 | 9th day | Carboplatin | 60 | 8th day |
| 5 | 5 | — | — | 9th day | Paclitaxel | 20 | 8th day |
| 6 | 5 | SW1208-mFa55 | 100 | 9th day | Paclitaxel | 20 | 8th day |
| 7 | 5 | — | — | 9th day | Gemcitabine | 120 | 8th day |
| 8 | 5 | SW1208-mFa55 | 100 | 9th day | Gemcitabine | 120 | 8th day |

(7-2-4) Assessment of Anti-Tumor Effect

The anti-tumor effect was assessed by the tumor volume calculated by the calculation formula provided in Example 7-2-1.

The tumor growth inhibition (TGI) value was calculated by the following calculation formula:

TGI (%)=(1−([the average value of the tumor volume in the tested group at the time of measurement]−[the average value of the tumor volume in the tested group at the time of the initial administration])/([the average value of the tumor volume in the control group at the time of measurement]−[the average value of the tumor volume in the control group at the time of the initial administration]))*100

As a result, the combined therapy of 100 mg/kg SW1208-mFa55 with 120 mg/kg gemcitabine showed more potent anti-tumor effect than the monotherapies (Table 13).

TABLE 13

| Drugs | TGI (%) on the 9th day after start of administration |
|---|---|
| SW1208-mFa55 | 24 |
| Carboplatin | 18 |
| Carboplatin + SW1208-mFa55 Combination | 23 |
| Paclitaxel | −1 |
| Paclitaxel + SW1208-mFa55 Combination | 11 |
| Gemcitabine | 18 |
| Gemcitabine + SW1208-mFa55 Combination | 36 |

(7-3) Assessment of Efficacy of Combined Use of an Anti-CTLA4 Switch Antibody and Various Chemotherapeutic Agents in a Syngeneic Tumor Cell Transplant Model (Lung Cancer Model) Using Wild-Type Mice (7-3-1) The Cell Line and Production of a Syngeneic Tumor Line Transplant Mouse Model Mouse lung cancer line LLC1 was purchased from ATCC (CRL-1642) and transfected with the chicken Ovalbumin (OVA, SEQ ID NO: 382) gene to constitutively express it. The cells were cloned and used in the experiment. LLC1/OVA cells were maintained and passaged in the D-MEM (high glucose) medium (NACALAI TESQUE, INC.) containing 10% FBS (CORNING) and 0.5 mg/mL G-418 (NACALAI TESQUE, INC.). The used mice were C57BL/6J (6-week-old, female) purchased from JACKSON LABORATORY JAPAN, INC.

The volume of transplanted tumor was calculated by the following formula:

Tumor volume=long diameter×short diameter×short diameter/2

(7-3-2) Preparation of Agents for Administration

The anti-mouse CTLA4 switch antibody (SW1208-mFa55) prepared in Reference Example 3-4 and carboplatin, paclitaxel, or gemcitabine as a chemotherapeutic agent were administered to the LLC1/OVA cell transplant model as the agents for administration. SW1208-mFa55 was prepared at 10 mg/mL using D-PBS. Carboplatin was prepared at 8 mg/mL using physiological saline, gemcitabine was prepared at 12 mg/mL using physiological saline, and paclitaxel was prepared at 2 mg/mL using ethanol, Cremophor EL, and physiological saline (1:1:18).

(7-3-3) Administration of the Agents for Measurement of Anti-Tumor Effect

The chemotherapeutic agent was administered on the 11th day after transplantation, and SW1208-mFa55 was administered on the 12th day after transplantation. SW1208-mFa55 was administered at a dose of 100 mg/kg, carboplatin was administered at a dose of 80 mg/kg, gemcitabine was administered at a dose of 120 mg/kg, and paclitaxel was administered at a dose of 20 mg/kg, to the mice. The prepared administration solution was administered at a volume of 10 mL/kg through the tail vein.

Table 14 shows the details of the treatment with the agents for measurement of anti-tumor effect.

TABLE 14

| Group | Heads | Drug 1 | Dose (mg/kg) | Administration date (after transplantation) | Drug 2 | Dose (mg/kg) | Administration date (after transplantation) |
|---|---|---|---|---|---|---|---|
| 1 | 5 | Vehicle | — | 12th day | — | — | 11th day |
| 2 | 5 | SW1208-mFa55 | 100 | 12th day | — | — | 11th day |
| 3 | 5 | — | — | 12th day | Carboplatin | 80 | 11th day |
| 4 | 5 | SW1208-mFa55 | 100 | 12th day | Carboplatin | 80 | 11th day |
| 5 | 5 | — | — | 12th day | Paclitaxel | 20 | 11th day |
| 6 | 5 | SW1208-mFa55 | 100 | 12th day | Paclitaxel | 20 | 11th day |
| 7 | 5 | — | — | 12th day | Gemcitabine | 120 | 11th day |
| 8 | 5 | SW1208-mFa55 | 100 | 12th day | Gemcitabine | 120 | 11th day |

(7-3-4) Assessment of Anti-Tumor Effect

The anti-tumor effect was assessed by the tumor volume calculated by the calculation formula provided in Example 7-3-1.

The tumor growth inhibition (TGI) value was calculated by the following calculation formula:

TGI (%)=(1−([the average value of the tumor volume in the tested group at the time of measurement]−[the average value of the tumor volume in the tested group at the time of the initial administration])/([the average value of the tumor volume in the control group at the time of measurement]−[the average value of the tumor volume in the control group at the time of the initial administration]))*100

As a result, the combined therapies of 100 mg/kg SW1208-mFa55 with 80 mg/kg carboplatin and 120 mg/kg gemcitabine showed more potent anti-tumor effect than the monotherapies (Table 15).

TABLE 15

| Drugs | TGI (%) on the 15th day after start of administration |
|---|---|
| SW1208-mFa55 | 23 |
| Carboplatin | 34 |
| Carboplatin + | 50 |

TABLE 15-continued

| Drugs | TGI (%) on the 15th day after start of administration |
|---|---|
| SW1208-mFa55 Combination | |
| Paclitaxel | 14 |
| Paclitaxel + SW1208-mFa55 Combination | 22 |
| Gemcitabine | 36 |
| Gemcitabine + SW1208-mFa55 Combination | 51 |

Example 8

Assessment of In Vivo Efficacy of Combined Use of Anti-CTLA4 Switch Antibodies and Immune Checkpoint Inhibitors in Mouse Models Transplanted with Syngeneic Tumor Lines (8-1) Assessment of Efficacy of Combined Use of Anti-CTLA4 Switch Antibodies and Anti-Mouse PDL1 Antibody in a Syngeneic Tumor Cell Transplant Model (Colon Cancer Model) Using Human CTLA4 Knock-In, Human CD3 Transgenic Mice (8-1-1) The Cell Line Mouse colon cancer line Colon 38 cells were donated from Japanese Foundation For Cancer Research under the agreement of NCI (National Cancer Institute) and used in the experiment. Colon 38 cells were maintained and passaged in the RPMI1640 medium (NACALAI TESQUE, INC.) containing 10% FBS (CORNING).

(8-1-2) Production of a Syngeneic Tumor Line Transplant Mouse Model

Human CTLA4 KI, human CD3 EDG replaced mice (hCTLA4 KI hCD3 EDG replaced mice) (12-week-old, male, or 7-week-old, female), which are a hybrid strain of human CTLA4 knock-in mice (Blood (2005) 106 (9): 3127-3133) and in-house-produced human CD3 EDG replaced mice (Sci Rep (2017) 7:45839), were used.

The volume of transplanted tumor was calculated by the following formula:

Tumor volume=long diameter×short diameter×short diameter/2

(8-1-3) Preparation of Agents for Administration

The anti-CTLA4 switch antibody (SW1610-mFa55 or SW1389-mFa55) prepared in Reference Example 3-4 and Reference Example 5-2 was administered to the Colon 38 cell transplant model as the agent for administration. The switch antibodies (SW1610-mFa55, SW1389-mFa55) were prepared at 0.03 mg/mL and 0.1 mg/mL, respectively, and the anti-mouse PDL1 antibody (Bio X Cell, InVivoMAb anti-mouse PD-L1 (B7-H1), #BE0101) was prepared at 1 mg/mL, using D-PBS.

(8-1-4) Administration of the Agents for Measurement of Anti-Tumor Effect

On the 14th day after transplantation, SW1610-mFa55 at a dose of 0.3 mg/kg and SW1389-mFa55 at a dose of 1 mg/kg were administered to mice through the tail vein. On the 14th, 17th, and 20th days, or the 14th and 17th days after transplantation, the anti-PDL1 antibody (aPDL1) was administered at 10 mg/kg to mice through the tail vein in the anti-PDL1 antibody single administration groups and the combined administration groups.

Tables 16 and 17 show the details of the treatment with the agents for measurement of anti-tumor effect.

TABLE 16

| Group | Heads | Drug 1 | Dose | Administration date (after transplantation) | Drug 2 | Dose | Administration date (after transplantation) |
|---|---|---|---|---|---|---|---|
| 1 | 5 | Vehicle | — | 14th day | Vehicle | — | 14th, 17th, and 20th days |
| 2 | 5 | SW1610-mFa55 | 0.3 | 14th day | Vehicle | — | 14th, 17th, and 20th days |
| 3 | 5 | Vehicle | — | 14th day | aPDL1 | 10 | 14th, 17th, and 20th days |
| 4 | 5 | SW1610-mFa55 | 0.3 | 14th day | aPDL1 | 10 | 14th, 17th, and 20th days |

TABLE 17

| Group | Heads | Drug 1 | Dose | Administration date (after transplantation) | Drug 2 | Dose | Administration date (after transplantation) |
|---|---|---|---|---|---|---|---|
| 1 | 5 | Vehicle | — | 14th day | Vehicle | — | 14th and 17th days |
| 2 | 5 | SW1389-mFa55 | 1 | 14th day | Vehicle | — | 14th and 17th days |
| 3 | 5 | Vehicle | — | 14th day | aPDL1 | 10 | 14th and 17th days |
| 4 | 5 | SW1389-mFa55 | 1 | 14th day | aPDL1 | 10 | 14th and 17th days |

(8-1-5) Assessment of Anti-Tumor Effect

The anti-tumor effect was assessed by the tumor volume calculated by the calculation formula provided in Example 8-1-2.

The TGI (tumor growth inhibition) value was calculated by the following calculation formula:

TGI=(1−([the average value of the tumor volume in the tested group at the time of measurement]−[the average value of the tumor volume at a time before administration of the antibody])/([the average value of the tumor volume in the control group at the time of measurement]−[the average value of the tumor volume at a time before administration of the antibody]))*100

Figure 17:
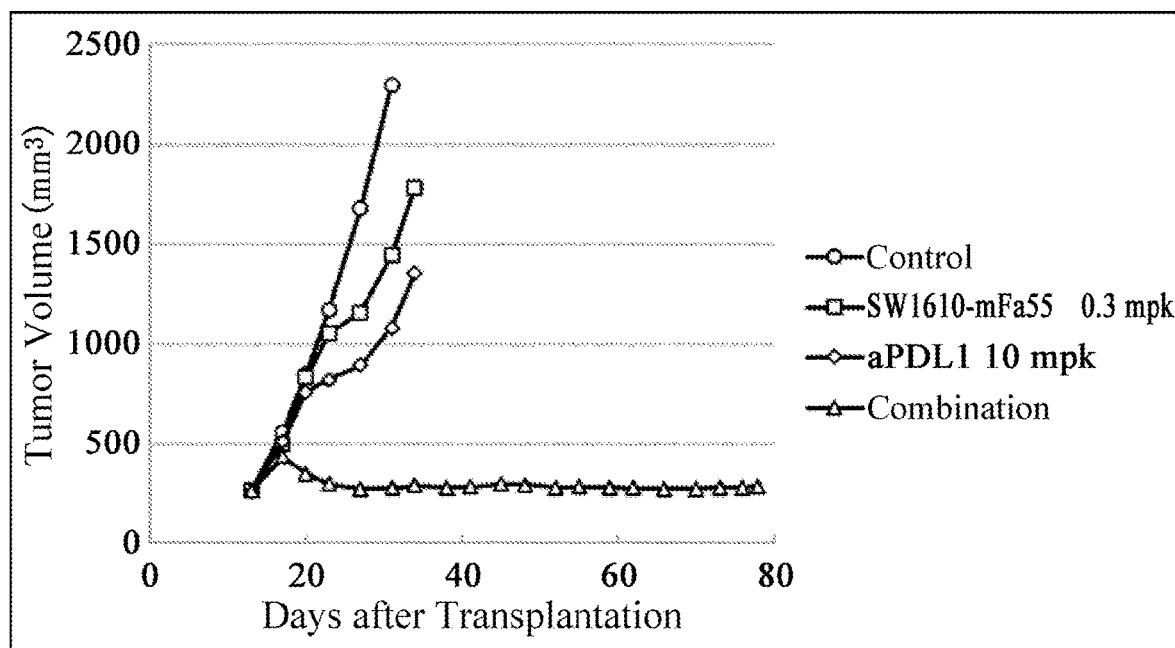
FIG. 17 shows the anti-tumor effect of combined use of anti-CTLA-4 antibody SW1610-mFa55 (switch antibody) and an anti-PD-L1 antibody in a mouse model transplanted with the Colon38 cell line (colon cancer) as described in Example 8. Through the tail vein, the switch antibody was administered at 0.3 mg/kg on day 14 after the transplantation, while the anti-PD-L1 antibody was administered at 10 mg/kg on days 14, 17, and 20 after the transplantation. Each point represents the average value of the tumor volume of a group (n=5).
Figure 18:
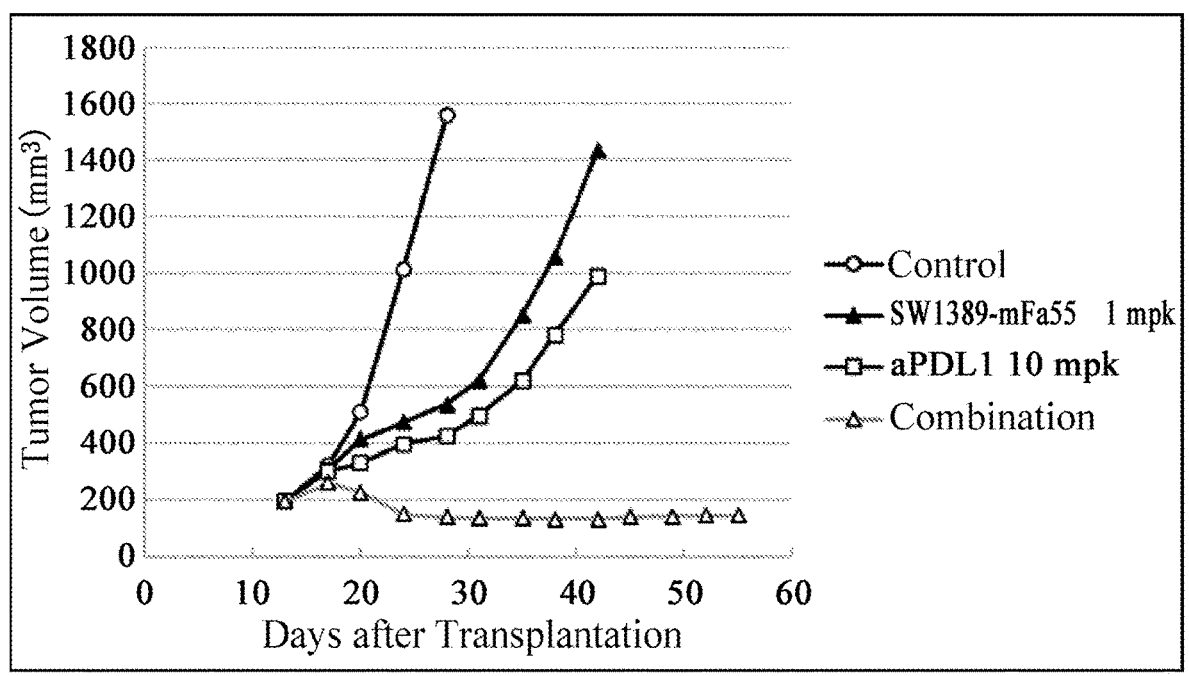
FIG. 18 shows the anti-tumor effect of combined use of anti-CTLA-4 antibody SW1389-mFa55 (switch antibody) and an anti-PD-L1 antibody in a mouse model transplanted with the Colon38 cell line (colon cancer) as described in Example 8. Through the tail vein, the switch antibody was administered at 1 mg/kg on day 14 after the transplantation, while the anti-PD-L1 antibody was administered at 10 mg/kg on days 14 and 17 after the transplantation. Each point represents the average value of the tumor volume of a group (n=5).

As a result, for both SW1610-mFa55 and 1389-mFa55, the combined therapy with the anti-PDL1 antibody showed more potent anti-tumor effect than the monotherapies. The results for SW1610-mFa55 and SW1389-mFa55 are shown in FIGS. 17 and 18, respectively.

Reference Example 1

Acquisition of Antibodies that Bind to Antigens in the Presence of ATP or a Metabolite Thereof from a Naive Library and a Rational Design Antibody Library Using the Phage Display Technique (1-1) Preparation of Antigens for Obtaining Antibodies that Bind to the Antigen in the Presence of a Small Molecule Biotinylated mouse CTLA4 extracellular region (mCTLA4), human CTLA4 extracellular region (hCTLA4), and Abatacept were prepared as antigens. Specifically, with regard to the hCTLA4 extracellular region, the gene of hCTLA4-His-BAP (SEQ ID NO: 1) in which His-tag and BAP-tag were fused to the C-terminus of the extracellular region of hCTLA4 was synthesized and inserted into an animal expression plasmid. The antigen protein was expressed and purified using the following method. The prepared plasmid was introduced by the lipofection method into the human embryonic kidney cell-derived FreeStyle 293-F line (Invitrogen), which had been seeded in a flask following suspension in the FreeStyle 293 Expression Medium (Invitrogen) at a cell density of $1.33 \times 10^6$ cells/mL. Three hours after the introduction of the plasmid, biotin was added to a final concentration of 100 µM, cultured in a $CO_2$ incubator (37° C., 8% $CO_2$, 125 rpm) for 4 days, and the antigen was purified by a method known to those skilled in the art from the culture supernatant. The absorbance of the purified antigen solution at 280 nm was measured using a spectrophotometer. The concentration of the purified antigen was calculated from the obtained measured value using the extinction coefficient calculated by the PACE method (Protein Science (1995) 4, 2411-2423). On the other hand, mCTLA4-His (Sino Biologics Inc. 50503-M08H, Accession No. NP_033973.2), in which the His-tag was fused to the extracellular region of mCTLA4, and Abatacept (Alfresa Corporation), in which the human IgG1 constant region was fused to hCTLA4, were biotinylated by the amine coupling method (PIERCE Cat. No. 21329).

(1-2) Acquisition of Antibodies that Bind to Mouse CTLA4 in the Presence of Small Molecules from a Naive Human Antibody Library by Bead Panning A human antibody phage display library consisting of multiple phages that present Fab domains of human antibody sequences different from each other was constructed according to a method known to those skilled in the art using, as a template, poly A RNAs prepared from human PBMCs, commercially available human poly A RNAs, and such.

From the constructed naive human antibody phage display library, antibodies whose binding activity to the extracellular region of mouse CTLA4 (mCTLA4) changes in the presence and absence of a small molecule were screened. More specifically, phages presenting antibodies showing binding activity to mCTLA4 captured on beads in the presence of a small molecule were collected. Phages were recovered from the phage eluate eluted from the beads in the absence of the small molecule. In this acquisition method, biotin-labeled mCTLA4 (mCTLA4-His-Biotin) was used as the antigen.

Phages produced from *E. coli* carrying the constructed phagemid for phage display were purified by the general method. Then, a phage library solution dialyzed against TBS was obtained. Panning was performed using the antigen immobilized onto magnetic beads. NeutrAvidin coated beads (Sera-Mag SpeedBeads NeutrAvidin-coated) or Streptavidin coated beads (Dynabeads M-280 Streptavidin) were used as the magnetic beads.

To efficiently obtain a small molecule-dependent small molecule switch antibody that can act as a switch in cancer tissues, panning was carried out referring to the method shown in the prior patent literature WO 2013/180200. This panning method enriches antibodies that bind to an antigen in the presence of adenosine 5'-triphosphate (ATP) and ATP metabolites, but do not bind to the antigen in the absence of ATP.

(1-3) Evaluation of the Binding Activity in the Presence and Absence of a Small Molecule by Phage ELISA From the single colonies of *E. coli* obtained in (1-2), a phage-containing culture supernatant was recovered according to a conventional method (Methods Mol. Biol. (2002) 178, 133-145). The culture supernatants recovered using NucleoFast 96 (MACHERY-NAGEL) were ultrafiltered. 100 µL of each culture supernatant was applied to each well of NucleoFast 96 and centrifuged at 4,500 g for 45 minutes to remove the flow-through. 100 µL of $H_2O$ was added and again washed by centrifugation at 4,500 g for 30 minutes. 100 µL of TBS was then added, and the mixture was left to stand at room temperature for 5 minutes, after which the phage solutions contained in the supernatants were recovered.

Purified phages to which TBS was added were subjected to ELISA by the following procedure. A StreptaWell 96 microtiter plate (Roche) was coated overnight with 100 µL of TBS containing mCTLA4-His-Biotin. After each well was washed with TBST to remove mCTLA4-His-Biotin not bound to the plate, the wells were blocked with 250 µL of 2% skim milk-TBS for 1 hour or longer. After removing 2% skim milk-TBS, the prepared purified phages were added to each well, and the plate was left to stand at room temperature for 1 hour, thereby allowing the antibody-presenting phages to bind to mCTLA4-His-Biotin present in each well in the absence or presence of ATP. After washing each well with TBST or ATP/TBST, an HRP-conjugated anti-M13 antibody (Amersham Pharmacia Biotech) diluted with TBS or ATP/TBS was added thereto and the plate was incubated for 1 hour. After washing with TBST or ATP/TBST, the color development reaction of the solution in each well to which TMB single solution (ZYMED) was added was stopped by the addition of sulfuric acid, and then the color development was measured by the absorbance at 450 nm. As a result, multiple antibodies that bound to mCTLA4 only in the presence of ATP were confirmed. The results of phage ELISA are shown in Table 18. Here, clones having an absorbance higher than 0.2 in the presence of ATP were determined to be positive, and clones having an absorbance ratio higher than 2 in the presence/absence of ATP were determined as clones having an ATP-dependent antigen-binding ability (switch clones). In this Example, SM may be used as an abbreviation for a small molecule/low-weight molecule such as ATP.

TABLE 18

|  | Total number |
|---|---|
| Number of ELISA-performed clones | 192 |
| Number of positive clones (Absorbance >0.2) | 103 |
| Number of switch clones (SM +/− ratio >2) | 28 |

(1-4) Acquisition of Antibodies that Bind to an Antigen in the Presence of a Small Molecule from a Rational Design Library Using ATP or a Metabolite Thereof From the rational design antibody phage display library constructed in the prior patent literature WO 2015/083764, antibodies showing antigen-binding activity under the condition of the presence of ATP or an ATP metabolite (for example, ADP, AMP, adenosine (ADO), etc.) were obtained. For antibody acquisition, phages presenting antibodies showing binding ability to the antigen captured onto the beads in the presence of ATP or an ATP metabolite were collected, and then the phages were recovered from the eluate eluted from the beads under the condition of the absence of ATP or the ATP metabolite.

Phages were produced by a general method from *E. coli* carrying the constructed phagemid for phage display. A phage library solution was obtained by diluting with TBS a population of phages precipitated by adding 2.5 M NaCl/10% PEG to the culture solution of *E. coli* in which phages were produced. Next, BSA was added to the phage library solution to have a final concentration of 4%. Panning was done using the antigen immobilized onto the magnetic beads. NeutrAvidin-coated beads (Sera-Mag SpeedBeads NeutrAvidin-coated) or Streptavidin-coated beads (Dynabeads M-280 Streptavidin) were used as the magnetic beads. Biotinylated Abatacept (Abatacept-Biotin) was used as the antigen.

To efficiently obtain a small molecule-dependent small molecule switch antibody that can act as a switch in cancer tissue, panning to enrich antibodies that bind to an antigen in the presence of adenosine 5'-triphosphate (ATP) or an ATP metabolite, and do not bind to the antigen in the absence of ATP or the ATP metabolite, was carried out referring to the method shown in the prior patent literature WO 2015/083674.

(1-5) Evaluation of Binding Activity in the Presence and Absence of ATP, or a Metabolite Thereof by Phage ELISA From the single colonies of *E. coli* obtained by the above method, a phage-containing culture supernatant was recovered according to a conventional method (Methods Mol. Biol. (2002) 178, 133-145). The recovered culture supernatant was ultrafiltered using NucleoFast 96 (MACHEREY-NAGEL). Flow-through was removed by centrifugation (4,500 g, 45 minutes) of NucleoFast 96 with 100 µL of culture supernatant added to each well. NucleoFast 96 added with 100 µL of H$_2$O to each well was again washed by centrifugation (4,500 g, 30 minutes). Finally, 100 µL of TBS was added, and the phage solution contained in the supernatant of each well of NucleoFast 96 that had been left to stand at room temperature for 5 minutes was recovered.

TBS or TBS containing ATP or a metabolite thereof (SM/TBS) was added to purified phages, and the phages were subjected to ELISA by the following procedure. A StreptaWell 96 microtiter plate (Roche) was coated overnight with 100 µL of TBS containing the biotin-labeled antigen (Abatacept-Biotin) prepared in Reference Example 1-1. After free Abatacept-Biotin was removed by washing each well of the plate with TBST, the wells were blocked with 250 µL of 2% skim milk-TBS for 1 hour or longer. After removing 2% skim milk-TBS, the prepared purified phages were added to each well, and the plate was left to stand at 37° C. for 1 hour, thereby allowing the phages presenting antibody to bind to Abatacept-Biotin present in each well in the absence or presence of ATP or a metabolite thereof. After each well of the plate was washed with TBST or TBST containing ATP or the metabolite thereof (SM/TBST), HRP-conjugated anti-M13 antibody (Amersham Pharmacia Biotech) diluted with TBS or SM/TBS was added thereto, and this plate was incubated for 1 hour. After washing the wells with TBST or SM/TBST, the color development reaction of the solution in each well to which TMB single solution (ZYMED) was added was stopped by the addition of sulfuric acid, and then the color development was measured by the absorbance at 450 nm. As a result, a plurality of antibodies whose binding activity to Abatacept changes in the presence and absence of ATP or the metabolite thereof were confirmed. The results of the phage ELISA are shown in Table 19. Here, clones having an absorbance S/N ratio higher than 2 in the presence of ATP or the metabolite thereof were determined to be positive, and clones having an absorbance ratio that is higher than 2 in the presence/absence of ATP or the metabolite thereof were determined to be clones having an antigen-binding ability dependent on ATP or the metabolite thereof (switch clones).

TABLE 19

|  | 4th Test | 5th Test | Total number |
|---|---|---|---|
| Number of ELISA-performed clones | 288 | 288 | 576 |
| Number of positive clones (S/N ratio >2) | 157 | 159 | 316 |
| Number of switch clones (SM +/− ratio >2) | 6 | 16 | 22 |

(1-6) Sequence Analysis of Switch Antibodies Whose Antigen-Binding Activity Changes Depending on the Presence or Absence of ATP and its Metabolites The nucleotide sequences of genes amplified using the specific primers lacPF (SEQ ID NO: 2) and G1seqR (SEQ ID NO: 3) from clones determined to have antigen-binding activity under the condition of the presence of ATP and its metabolites as a result of phage ELISA were analyzed. As a result of the analysis, clones ABADh11-4_020, ABADh11-4_086, ABADh12-4_014, ABADh12-5_001, ABADh12-5_046, and ABADh5-5_041 which were judged to have binding activity to biotin-labeled abatacept in the presence of ATP and its metabolites were obtained. The clone names were reassigned as ABAM001, ABAM002, ABAM003, ABAM004, ABAM005, and ABAM006, respectively (Table 20).

TABLE 20

| Clone name | Antibody name | VH SEQ ID NO: | VL SEQ ID NO: |
|---|---|---|---|
| ABADh11-4_020 | ABAM001 | 4 | 5 |
| ABADh11-4_086 | ABAM002 | 6 | 7 |
| ABADh12-4_014 | ABAM003 | 8 | 9 |
| ABADh12-5_001 | ABAM004 | 10 | 11 |
| ABADh12-5_046 | ABAM005 | 12 | 13 |
| ABADh5-5_041 | ABAM006 | 14 | 15 |

(1-7) Expression and Purification of Switch Antibodies Whose Antigen-Binding Activity Changes Depending on the Presence and Absence of ATP and its Metabolites The genes encoding the variable regions of ABAM001, ABAM002, ABAM003, ABAM004, ABAM005, and ABAM006 obtained from the human rational design phage library were inserted into the animal expression plasmid human IgG1/Lambda. The antibodies were expressed using the following method. The prepared plasmid was introduced by the lipofection method into the human embryonic kidney cell-derived FreeStyle 293-F line (Invitrogen), which had been suspended in the FreeStyle 293 Expression Medium (Invitrogen) at a cell density of $1.33 \times 10^6$ cells/mL, and seeded at 3 ml/well in each well of 6-well plates. Antibodies were purified from the culture supernatant cultured in a $CO_2$ incubator (37° C., 8% $CO_2$, 90 rpm) for 4 days using rProtein A Sepharose™ Fast Flow (Amersham Biosciences) by a method known to those skilled in the art. The absorbance of the purified antibody solutions at 280 nm was measured using a spectrophotometer. From the obtained measured values, the concentration of the purified antibodies was calculated using the extinction coefficient calculated by the PACE method (Protein Science (1995) 4, 2411-2423).

(1-8) Evaluation of Binding Activity of the Obtained Antibodies Against hCTLA4 in the Presence and Absence of AMP by IgG ELISA The obtained six antibodies of ABAM001, ABAM002, ABAM003, ABAM004, ABAM005, and ABAM006 were subjected to IgG ELISA. The buffers shown in Table 21 were appropriately prepared. Biotin-labeled human CTLA4 (hCTLA4-His-Biotin) was used as the antigen.

TABLE 21

| Buffer | Composition |
|---|---|
| Wash Buffer | TBS, 0.1% Tween20 |
| Blocking Buffer | TBS, 2% BSA |
| Sample Buffer | TBS, 1 mM AMP |

First, a StreptaWell 96 microtiter plate (Roche) was coated with 100 μL of TBS containing hCTLA4-His-Biotin at room temperature for 1 hour or longer. After each well of the plate was washed with Wash Buffer to remove hCTLA4-His-Biotin not bound to the plate, the wells were blocked with 250 μL of Blocking Buffer for 1 hour or longer. To each well from which the Blocking Buffer was removed, 100 μL of each of purified IgG prepared to 2.5 μg/mL in Sample Buffer containing AMP at a final concentration of 1 mM was added, and the plate was left to stand at room temperature for 1 hour, thereby allowing each IgG to bind to hCTLA4-His-Biotin present in each well. After washing with Wash Buffer containing AMP at a final concentration of 1 mM, a plate to which the HRP-conjugated anti-human IgG antibody (BIOSOURCE) diluted with Sample Buffer has been added to each well was incubated for 1 hour. After washing with Wash Buffer containing each small molecule, the color development reaction of the solution in each well to which TMB single solution (ZYMED) was added was stopped by the addition of sulfuric acid, and then the color development was measured by the absorbance at 450 nm. Buffers containing the compositions shown in Table 21 were used as buffers.

The measured results are shown in Table 22. Wells with overflowed values were assumed to be 5.00. The results showed that in all clones of ABAM001, ABAM002, ABAM003, ABAM004, ABAM005, and ABAM006, the absorbance in the absence of AMP was significantly lower than that in the presence of AMP. From this result, it was confirmed that all clones of ABAM001, ABAM002, ABAM003, ABAM004, ABAM005 and ABAM006 have the property of changing the binding to the antigen depending on the presence or absence of small molecules.

TABLE 22

| | 450 nm Absorbance | | |
|---|---|---|---|
| Antibody name | Presence of small molecule | Absence of small molecule | S/N |
| ABAM001 | 5.000 | 3.455 | 1.45 |
| ABAM002 | 5.000 | 0.139 | 35.97 |
| ABAM003 | 5.000 | 3.180 | 1.57 |
| ABAM004 | 5.000 | 0.643 | 7.78 |
| ABAM005 | 0.303 | 0.069 | 4.46 |
| ABAM006 | 2.995 | 0.776 | 3.86 |

(1-9) Evaluation of the Effect of ATP and its Metabolites on Binding to Human CTLA4 by Surface Plasmon Resonance ABAM004 was further evaluated as a CTLA4 switch antibody.

The interaction of the antigen-antibody reaction between ABAM004 and hCTLA4-His-BAP was analyzed using Biacore T200 (GE Healthcare). ABAM004 was allowed to capture by Sensor chip CM5 (GE Healthcare) onto which protein A/G (Pierce) was immobilized in an appropriate amount by the amine coupling method, and allowed to interact with the antigen hCTLA4-His-BAP prepared in Reference Example 1-1. TBS was used as the running buffer, and 10 mM Glycine-HCl (pH 1.5) was used as the regeneration solution.

After 1 μg/mL ABAM004 suspended in TBS was captured, a solution containing 500 nM hCTLA4-His-BAP and 10 concentrations of ATP, ADP or AMP diluted at a common ratio of 4 from 4000 μM, and 2 mM $MgCl_2$ was injected into each flow cell at a flow rate of 10 μL/min for 3 minutes. These 3 minutes were used as the binding phase of hCTLA4-His-BAP. After completion of the binding phase, the injection was switched to the running buffer for 2 minutes, which were used as the disassociation phase of hCTLA4-His-BAP. After completion of the dissociation phase, the regeneration solution was injected at a flow rate of 30 μL/min for 30 seconds. The above was taken as the binding activity measurement cycle of ABAM004. The binding amount of hCTLA-4-His-BAP that interacted with ABAM004 in the binding phase was corrected for the amount of captured antibody. Biacore T200 Evaluation Software Version: 2.0 and Microsoft Excel 2013 (Microsoft) were used to analyze and plot the data.

Figure 19:
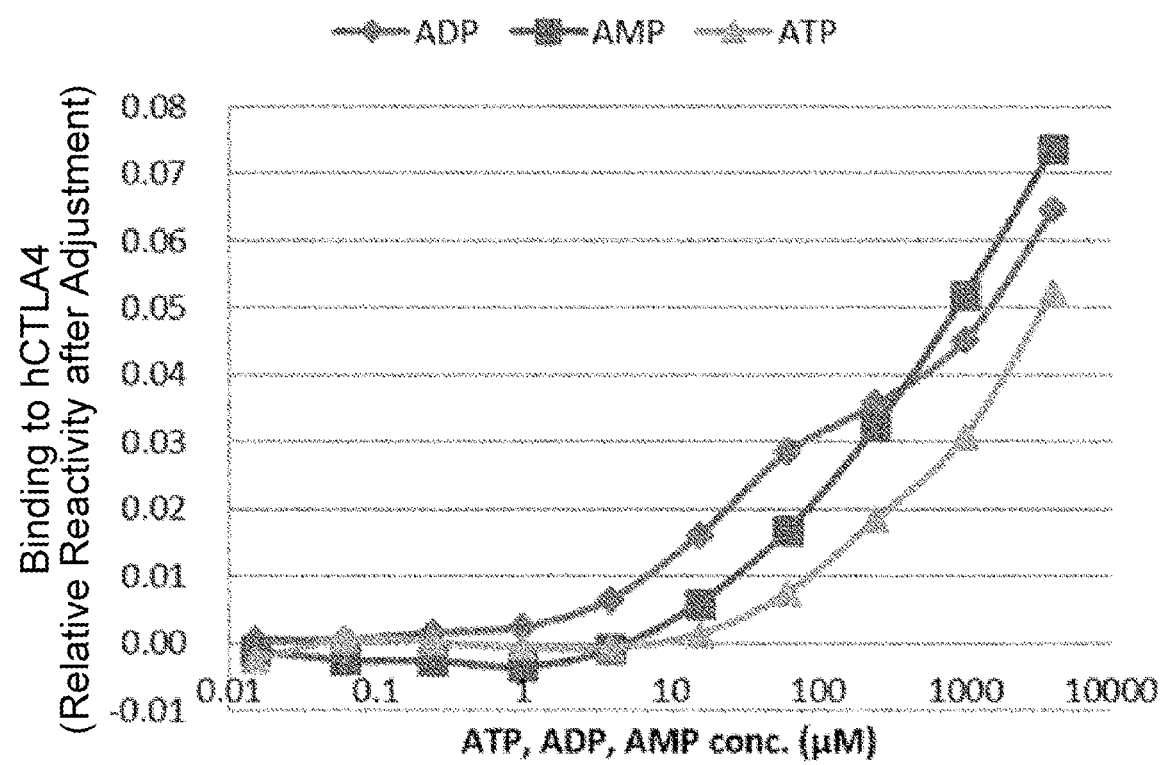
FIG. 19 shows the binding activity of the anti-CTLA-4 antibody ABAM004 to CTLA-4, which binding activity depends on the concentration of ATP, ADP, or AMP as described in Reference Example 1-9.

FIG. 19 shows the binding amount of ABAM004 and hCTLA4-His-BAP in the presence of ATP and its metabolites obtained by this measurement.

As shown in FIG. 19, it was confirmed that ABAM004 has the property of binding to hCTLA4 using not only ATP but also ATP metabolites as a switch. In addition, it was shown that the antibody has the strongest binding activity especially in the presence of AMP.

(1-10) Evaluation of Antibody Binding to Human CTLA4-Expressing Cells

Figure 20:
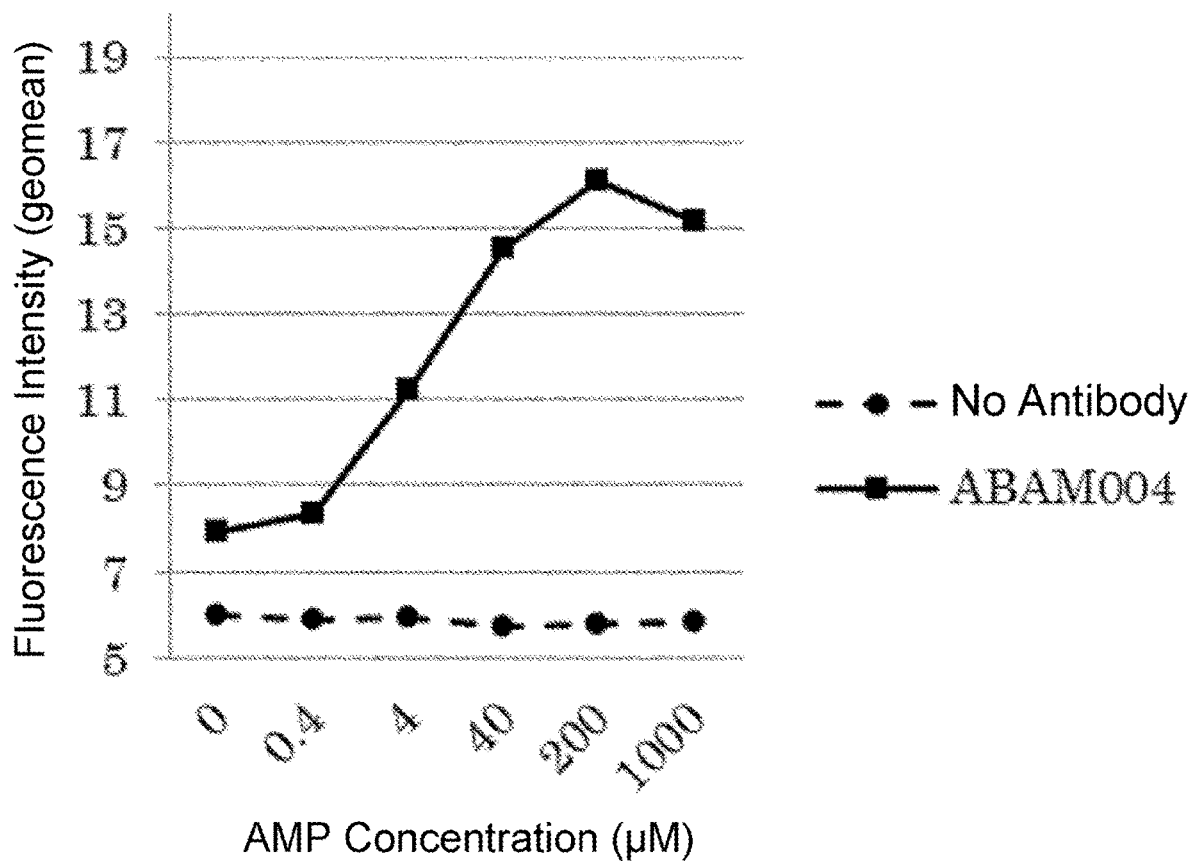
FIG. 20 shows the binding activity of the anti-CTLA-4 antibody ABAM004 to CTLA-4-expressing cells, which binding activity depends on the concentration of AMP as described in Reference Example 1-10.

A flow cytometer was used to evaluate how the antigen-antibody interaction between ABAM004 and human CTLA4 changes in the presence and absence of AMP. CHO cells that stably express human CTLA4 (hCTLA4-CHO cells) were prepared at an appropriate concentration. At this time, PBS containing 0.1% BSA (FACS Buffer) was used for the suspension. Antibody was added to 100 µL of the cell solution to a final concentration of 10 mg/mL, and then AMP was added to a final concentration of 0, 0.4, 4, 40, 200 and 1000 µM, and left to stand at 4° C. for 30 minutes. After that, the cell line was washed with Wash Buffer, which is the FACS Buffer containing AMP at a final concentration of 0, 0.4, 4, 40, 200 and 1000 µM, and then FITC-labeled secondary antibody (Goat F(ab'2) Anti-Human IgG Mouse ads-FITC, Beckman, 732598) was added and left to stand again at 4° C. for 30 minutes in the dark. After the washing operation was performed again, measurements and analysis were done using a flow cytometer (FACS CyAn™ ADP). The results are shown in FIG. 20.

The above results show that ABAM004 demonstrated AMP concentration-dependent binding activity to hCTLA4-expressing cells, and showed AMP concentration-dependent binding activity not only to soluble antigens, but also to membrane-type antigens.

(1-11) ADCC Activity of a Test Antibody Using Human Peripheral Blood Mononuclear Cells as Effector Cells The antibody concentration-dependent ADCC activity of an antibody that binds to an antigen in an ATP-dependent manner was measured according to the following method. At this time, the ADCC activity of the test antibody was measured as follows using human peripheral blood mononuclear cells (hereinafter referred to as human PBMC) as effector cells.

First, a human PBMC solution was prepared. 50 mL of peripheral blood was collected from healthy volunteers (adult males) using a syringe already containing 200 µL of 1000 units/mL heparin solution (Novo-heparin injection 5000 units, Novo Nordisk). Peripheral blood diluted 2-fold with PBS (–) was divided into 4 aliquots, and added to Leucosep lymphocyte separation tubes (Greiner Bio-One) which had been centrifuged after pre-injecting 15 ml of Ficoll-Paque PLUS. The separation tubes into which the peripheral blood was aliquoted were centrifuged at 2150 rpm for 10 minutes at room temperature, and then the mononuclear cell fractions were separated. After washing the cells contained in the fractions once with RPMI-1640 (Nacalai Tesque) containing 10% FBS (hereinafter referred to as 10% FBS/RPMI), the cells were suspended in 10% FBS/RPMI to a cell density of $1\times10^7$ cells/mL. The cell suspension was used as a human PBMC solution for subsequent experiments.

Next, as target cells, hCTLA4-CHO cells, prepared by forcibly expressing the human CTLA4 extracellular region in CHO cells, were suspended and prepared in 10% FBS/RPMI so as to be $2\times10^5$ cells/mL. Furthermore, AMP (Sigma) diluted to 4 mM using RPMI was used as the AMP solution for subsequent tests.

ADCC activity was evaluated by LDH (lactate dehydrogenase) release. First, 50 µL of antibody solution prepared at each concentration (0, 0.04, 0.4, 4, and 40 µg/mL) was added to each well of a 96-well U-bottomed plate, to which 50 µL each of target cells were seeded ($1\times10^4$ cells/well). Furthermore, 50 µL of the AMP solution was added to each well, and the mixture was left to stand at room temperature for 15 minutes. 50 µL ($5\times10^5$ cells/well) of human PBMC solution was added to each well, and the plate was centrifuged and then left to stand at 37° C. for 4 hours in a 5% carbon dioxide incubator. After completion of the reaction, 100 µL of the culture supernatant was collected and transferred to a 96-well plate for measurement, and then Catalyst (C) and Dye solution (D) attached to the LDH detection kit (TaKaRa) were mixed at 1:45, and 100 µL of this mixture was added. After allowing to react at room temperature for 15 minutes, 50 µL of 1N HCl was added to stop the reaction. Absorbance at 492 nm was measured and ADCC activity was measured by LDH release. ADCC activity was determined based on the following formula.

$$\text{ADCC activity } (\%) = \{(A-D)-(C-D)\} \times 100 / \{(B-D)-(C-D)\}$$

Figure 21:
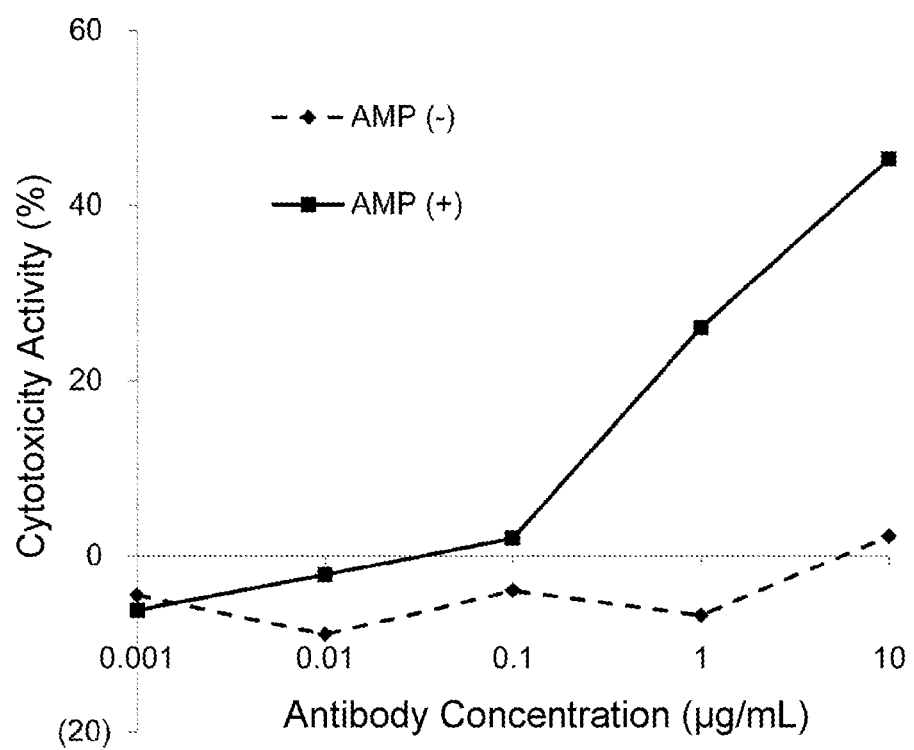
FIG. 21 shows the ADCC activity of the anti-CTLA-4 antibody ABAM004 to CTLA-4-expressing cells in the presence and absence of AMP as described in Reference Example 1-11.

In the above formula, A represents the mean value of LDH activity (OD 492 nm) in the wells to which each test antibody was added. B represents the mean value of LDH activity (OD 492 nm) in the wells to which 10 µL of 20% Triton-X aqueous solution was added after the reaction. C represents the mean value of LDH activity (OD 492 nm) in the wells to which 150 µL of 10% FBS/RPMI, or 100 µL of 10% FBS/RPMI and 50 µL of AMP solution was added to target cells. D represents the mean value of LDH activity (OD 492 nm) in the wells containing only 10% FBS/RPMI. The test was carried out in duplicates, and the mean value of ADCC activity (%) in the test reflecting the ADCC activity of the test antibody was calculated. The results are shown in FIG. 21.

From the above results, it was shown that the antibody ABAM004 has antigen-binding activity in the presence of AMP and has the ability to kill target cells by exerting ADCC activity.

Reference Example 2

Crystal Structure Analysis of an Anti-CTLA4 Antibody Having ATP-Dependent Binding Properties (2-1) X-Ray Crystal Structure Analysis of the Anti-CTLA4-Binding Antibody ABAM004 that Uses AMP as a Switch For the hCTLA4-binding antibody ABAM004, which uses AMP as a switch and was obtained from the library in Reference Example 1, the crystal structures of the Fab fragment of ABAM004 alone, a complex of the Fab fragment of ABAM004 and AMP, and a complex of the Fab fragment of ABAM004, AMP, and hCTLA4 extracellular domain were analyzed.

(2-2) Preparation of the ABAM004 Full-Length Antibody for Crystallization

Preparation and purification of the ABAM004 full-length antibody for crystallization were carried out by a method known to those skilled in the art.

(2-3) Preparation of the Fab Fragment for Crystal Structure Analysis of the ABAM004 Fab Fragment The ABAM004 Fab fragment was prepared by the conventional method of restriction digestion with rLys-C (Promega, catalog number V1671), followed by loading onto a Protein A column (MabSelect SuRe, GE Healthcare), cation exchange column (HiTrap SP HP, GE Healthcare), and gel filtration column (Superdex200 16/60, GE Healthcare) for removing Fc fragments. Fractions containing Fab fragments were pooled and stored at –80° C.

(2-4) Generation of ABAM004 Fab Fragment Crystals

The Fab fragment of ABAM004 for crystallization purified by the method of 2-3 was concentrated to about 13 mg/mL and crystallized at 20° C. by the sitting-drop vapor-diffusion technique. The reservoir solution consisted of 0.1 M MES, pH 6.5, 25% w/v polyethylene glycol 4000. The resulting crystals were immersed in a solution of 0.08 M MES, pH 6.5, 20% w/v polyethylene glycol 4000 and 20% ethylene glycol.

(2-5) Collection of X-Ray Diffraction Data from Crystals of the ABAM004 Fab Fragment and Structure Determination X-ray diffraction data was measured by BL-17A of the radiation facility, Photon Factory, of the High Energy Accelerator Research Organization. During the measurement, the crystals were constantly kept frozen under a stream of nitrogen at −178° C., and a total of 360 X-ray diffraction images were collected using the Quantum 270 CCD detector (ADSC) connected to the beamline, while rotating the crystals 0.5° at a time. Determination of cell parameters, indexing of diffraction spots, and processing of diffraction data from diffraction images were done using the Xia2 program (J. Appl. Cryst. 43:186-190 (2010)), XDS package (Acta. Cryst. D 66: 125-132 (2010)) and Scala (Acta. Cryst. D 62: 72-82 (2006)), and diffraction intensity data up to a resolution of 1.70 Å were finally obtained. Crystallographic data statistics are shown in Table 23.

The structure was determined by the molecular substitution method using the program Phaser (J. Appl. Cryst. (2007) 40, 658-674). The Fab fragment search model was derived from the published Fab crystal structure (PDB code: 4NKI). The model was built with the Coot program (Acta Cryst. D 66: 486-501 (2010)) and refined with the program Refmac5 (Acta Cryst. D 67: 355-467 (2011)). The crystallographic reliability factor (R) of the diffraction intensity data from 52.92-1.70 Å was 16.92% and the Free R value was 21.22%. Structural refinement statistics are shown in Table 23.

loading onto a Protein A column (MabSelect SuRe, GE Healthcare), cation exchange column (HiTrap SP HP, GE Healthcare), and gel filtration column (Superdex200 16/60, GE Healthcare) for removing Fc fragments. Fractions containing Fab fragments were pooled and stored at −80° C.

(2-7) Generation of Crystals of a Complex of ABAM004 Fab Fragment and AMP

The Fab fragment of ABAM004 for crystallization purified by the method of 2-6 was concentrated to about 13 mg/mL, to which AMP was added so as to make the final concentration of 2 mM, and crystallization was performed at 20° C. by the sitting-drop vapor-diffusion technique. The reservoir solution consisted of 0.1 M Morpheus buffer 2, pH 7.5, 37.5% w/v MPD_P1K_P3350, 10% Morpheus Carboxylic acids (Morpheus, Molecular Dimensions).

(2-8) Collection of X-Ray Diffraction Data from Crystals of a Complex of ABAM004 Fab Fragment and AMP and Structure Determination X-ray diffraction data was measured by BL-1A of the radiation facility, Photon Factory, of the High Energy Accelerator Research Organization. During the measurement, the crystals were constantly kept frozen under a stream of nitrogen at −178° C., and 720 X-ray diffraction images were collected using the Pilatus 2M detector (DECTRIS) connected to the beamline, while rotating the crystals by 0.25° at a time. Determination of cell parameters, indexing of diffraction spots, and processing of diffraction data from diffraction images were done using the Xia2 program (J. Appl. Cryst. 43:186-190 (2010)), XDS package (Acta. Cryst. D 66: 125-132 (2010)) and Scala (Acta. Cryst. D 62: 72-82 (2006)), and diffraction intensity data up to a resolution of 1.70 Å were finally obtained. Crystallographic data statistics are shown in Table 23.

TABLE 23

X ray data collection and refinement statistics

| Data collection | ABAM004fab | ABAM004fab-AMP | ABAM004fab-AMP-CTLA4 |
|---|---|---|---|
| Space group | $P2_12_12_1$ | $P42_12$ | $P4_12_12$ |
| Unit cell dimensions | | | |
| a, b, c (Å) | 64.27, 70.86, 79.59 | 135.75, 135.75, 66.04 | 72.29, 72.29, 309.31 |
| α, β, γ (°) | 90.00, 90.00, 90.00 | 90.00, 90.00, 90.00 | 90.00, 90.00, 90.00 |
| Resolution (Å) | 52.92-1.70 | 47.33-2.89 | 52.81-3.09 |
| Number of total reflections | 296585 | 181799 | 157732 |
| Number of unique reflections | 40500 | 14366 | 16037 |
| Completeness (Outmost shell) | 99.6 (98.8) | 100.0 (100.0) | 99.9 (99.9) |
| $R_{merge}^a$(Outmost shell) (%) | 5.8 (67.6) | 17.3 (88.7) | 14.1 (63.2) |
| Refinement | | | |
| Resolution (Å) | 52.92-1.70 | 47.33-2.89 | 52.81-3.09 |
| Number of reflections | 38523 | 13658 | 15145 |
| R factors$^b$ ($R_{free}^c$) (%) | 16.92 (21.22) | 19.97 (25.62) | 23.49 (31.02) |
| rms Deviation from ideal value | | | |
| Bond lengths (Å) | 0.0128 | 0.0037 | 0.0038 |
| Bond angles (°) | 1.7102 | 0.9275 | 0.8442 |

$^a R_{merge} = \Sigma$ hkl $\Sigma$ j| I j(hkl) − <I(hkl)> |/$\Sigma$ hkl $\Sigma$ j| I j(hkl) |, here Ij(hkl) and <I(hkl)> are respectively intensity of measurement j and mean reflection intensity having the exponential hkl.
$^b$R factors = $\Sigma$ hkl |$F_{calc}$(hkl) | − | $F_{obs}$(hkl) |/$\Sigma$ hkl | $F_{obs}$ (hkl) |, here $F_{obs}$ and $F_{calc}$ are respectively observed and calculated amplitudes of structural factors.
$^c R_{free}$ is calculated from 5% of reflections randomly not used.

(2-6) Preparation of the ABAM004 Fab Fragment from Full-Length Antibody for Crystal Structure Analysis of a Complex of ABAM004 Fab Fragment and AMP, and a Complex of ABAM004 Fab Fragment, AMP, and hCTLA4

The Fab fragment of ABAM004 was prepared by the conventional method of restriction digestion with papain (Roche Diagnostics, Catalog No. 1047825), followed by The structure was determined by the molecular substitution method using the program Phaser (J. Appl. Cryst. (2007) 40, 658-674). The Fab fragment search model was derived from the published Fab crystal structure (PDB code: 4NKI). The model was built with the Coot program (Acta Cryst. D 66: 486-501 (2010)) and refined with the program Refmac5 (Acta Cryst. D 67: 355-367 (2011)). The crystallographic reliability factor (R) of the diffraction intensity data from 47.33-2.89 Å was 19.97% and the Free R value was 25.62%. Structural refinement statistics are shown in Table 23.

(2-9) Preparation of hCTLA4 Extracellular Domain

The extracellular domain of hCTLA4 was prepared by the conventional method of restriction digestion of abatacept by Endoproteinase Lys-C(Roche, catalog number 11047825001), followed by loading onto a protein A column (MabSelect SuRe, GE Healthcare) and a gel filtration column (Superdex200 10/300, GE Healthcare) for removing Fc fragments. Fractions containing the extracellular domain of hCTLA4 were pooled and stored at −80° C.

(2-10) Preparation of a Complex of ABAM004 Fab Fragment, AMP, and hCTLA4 Extracellular Domain The hCTLA4 extracellular domain purified by the method of 2-9 was mixed with the Fab fragment of ABAM004 purified by the method of 2-6 in a molar ratio of 1.5:1, and AMP was added thereto so as to make the final concentration of 2 mM. The complex was purified by gel filtration chromatography (Superdex200 10/300, GE Healthcare) using a column equilibrated with 25 mM HEPES, pH 7.5, 100 mM NaCl, 2 mM AMP.

(2-11) Generation of Crystals of a Complex of ABAM004 Fab Fragment, AMP, and hCTLA4 Extracellular Domain The purified complex was concentrated to about 8 mg/mL and crystallized at 20° C. by the sitting-drop vapor-diffusion technique combined with the seeding method. The reservoir solution consisted of 0.1 M Morpheus buffer 1, pH 6.5, 37.5% w/v M1K3350, 10% halogens (Morpheus, Molecular Dimensions).

(2-12) Collection of X-Ray Diffraction Data from Crystals of a Complex of ABAM004 Fab Fragment, AMP and hCTLA4 Extracellular Domain and Structure Determination X-ray diffraction data was measured with BL32XU of SPring-8. During the measurement, the crystals were constantly kept frozen under a nitrogen flow of −178° C., and a total of 180 X-ray diffraction images were collected using the MX-225HS CCD detector (RAYONIX) connected to the beamline, while rotating the crystals 1.0° at a time. Determination of cell parameters, indexing of diffraction spots, and processing of diffraction data from diffraction images were done using the Xia2 program (J. Appl. Cryst. 43:186-190 (2010)), XDS package (Acta. Cryst. D 66: 125-132 (2010)) and Scala (Acta. Cryst. D 62: 72-82 (2006)) and diffraction intensity data up to a resolution of 1.70 Å were finally obtained. Crystallographic data statistics are shown in Table 23.

The structure was determined by the molecular substitution method using the program Phaser (J. Appl. Cryst. (2007) 40, 658-674). The Fab fragment search model was derived from the published Fab crystal structure (PDB code: 4NKI), and the hCTLA4 extracellular domain search model was derived from the published human CTLA4 crystal structure (PDB code: 3OSK, J. Biol. Chem. 286:6685-6696 (2011)). The model was built with the Coot program (Acta Cryst. D 66: 486-501 (2010)) and refined with the program Refmac5 (Acta Cryst. D 67: 355-367 (2011)). The crystallographic reliability factor (R) of the diffraction intensity data from 52.81-3.09 Å was 23.49% and the Free R value was 31.02%. Structural refinement statistics are shown in Table 23.

(2-13) Identification of the Interaction Site Between ABAM004 and AMP

The crystal structure revealed that AMP is mainly recognized by the heavy chain of the antibody.

The adenine ring moiety of AMP is recognized by heavy chain CDR1 and CDR3, and the ribose moiety and phosphate group moiety are recognized by CDR1 and CDR2.

Figure 22:
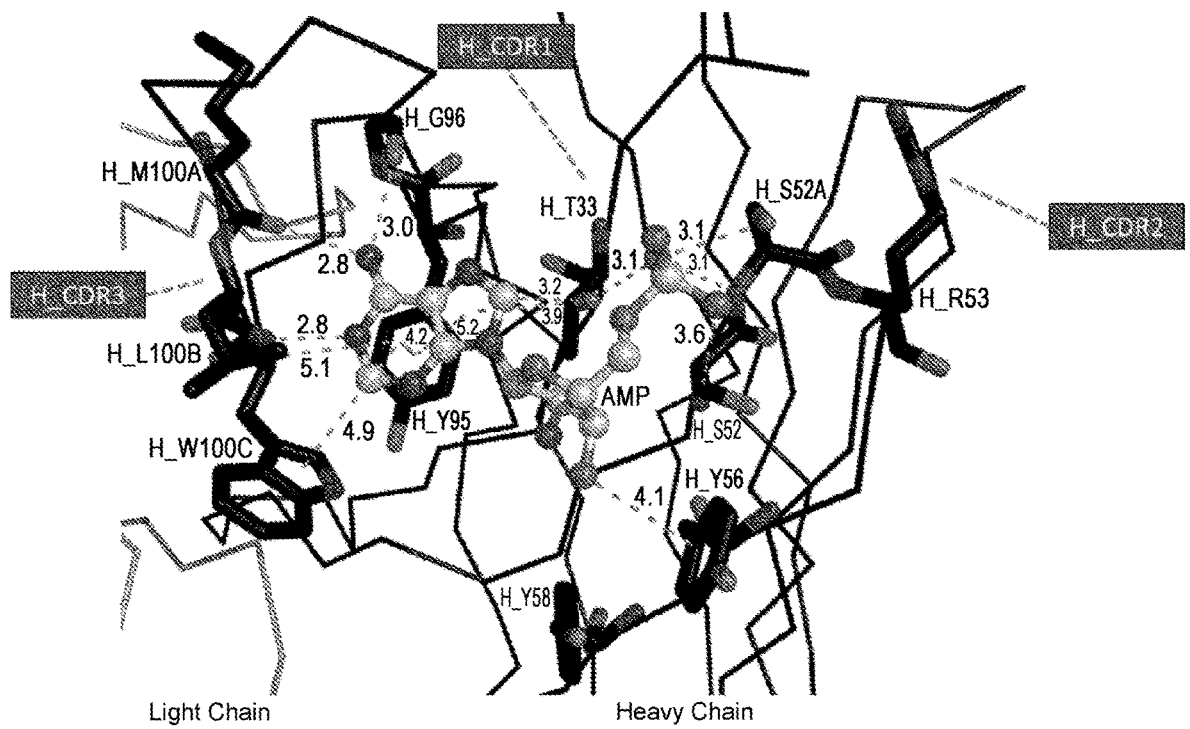
FIG. 22 shows the binding mode of ABAM004 Fab fragment and AMP as described in Reference Example 2-13. In the figure, the heavy chain of the antibody is indicated in black, the light chain in gray, and AMP in a ball-and-stick model. The amino acid residues forming interaction with AMP are indicated in a stick model. Dashed lines and their values indicate the distance (Å) between each amino acid residue and AMP.

Specifically, as shown in FIG. 22, the adenine ring moiety of AMP is recognized by the side chains of T33 belonging to the heavy chain CDR1 and Y95, L100B, and W100C belonging to CDR3, and the main chains of G96 and M100A of the antibody. In particular, it was found that the carbonyl oxygens in the main chains of G96 and M100A form hydrogen bonds with N at position 6 of AMP, the main chain amide NH group of W100C forms a hydrogen bond with N at position 1, and the side chains of Y95, L100B, and W100C form an interaction using the pi-electrons of the adenine ring moiety, such that the antibody strongly recognizes the adenine ring moiety. The ribose moiety is recognized by each of the side chains of T33 belonging to heavy chain CDR1, and Y56 and Y58 belonging to CDR2 through the van der Waals interaction and through the interaction by the pi-electrons of Y56. In addition, the phosphate group moiety is recognized by each of the side chains of T33 belonging to the heavy chain CDR1 and S52, S52A, and R53 belonging to CDR2, and the main chain of S52A. In particular, it is thought that the hydrogen bonds formed by the side chain of T33 and the main chain amide NH group of S52A with the phosphate group moiety and the van der Waals interaction by S52 and R53 play an important role in recognizing the phosphate group moiety. The amino acid residue numbering of Fab is based on the Kabat numbering scheme.

(2-14) Identification of the Epitopes of ABAM004

Figure 23:
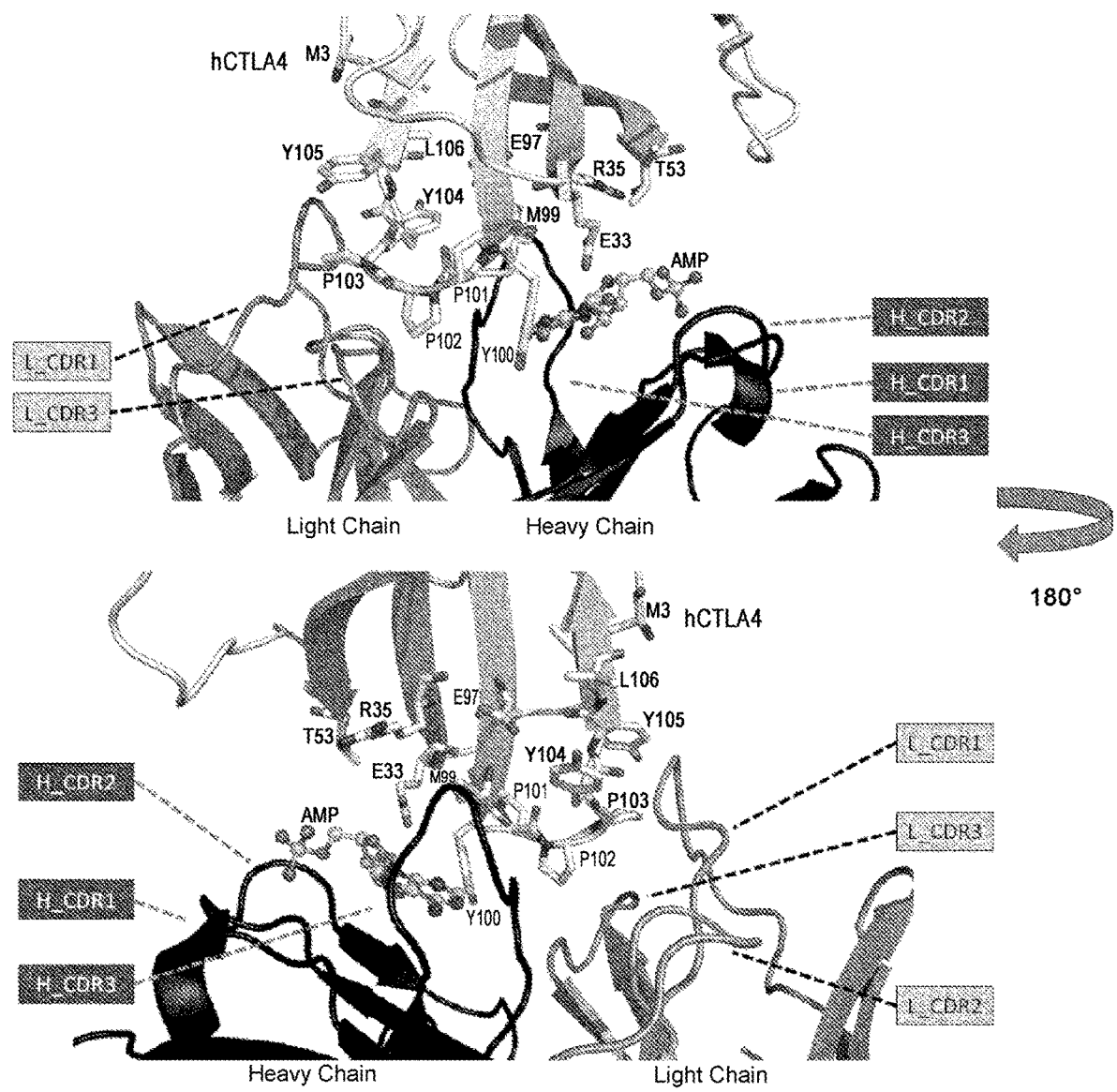
FIG. 23 shows the binding mode of ABAM004 Fab fragment, AMP, and human CTLA4 (hCTLA4) as described in Reference Example 2-14. In the figure, the heavy chain of the antibody is indicated in black, the light chain in gray, hCTLA4 in white, and AMP in a ball-and-stick model. The amino acid residues of hCTLA4 that comprise one or more non-hydrogen atoms located within a distance of 4.2 Å from any part of the antibody or AMP are taken as an epitope and indicated in a stick model.
Figure 24:
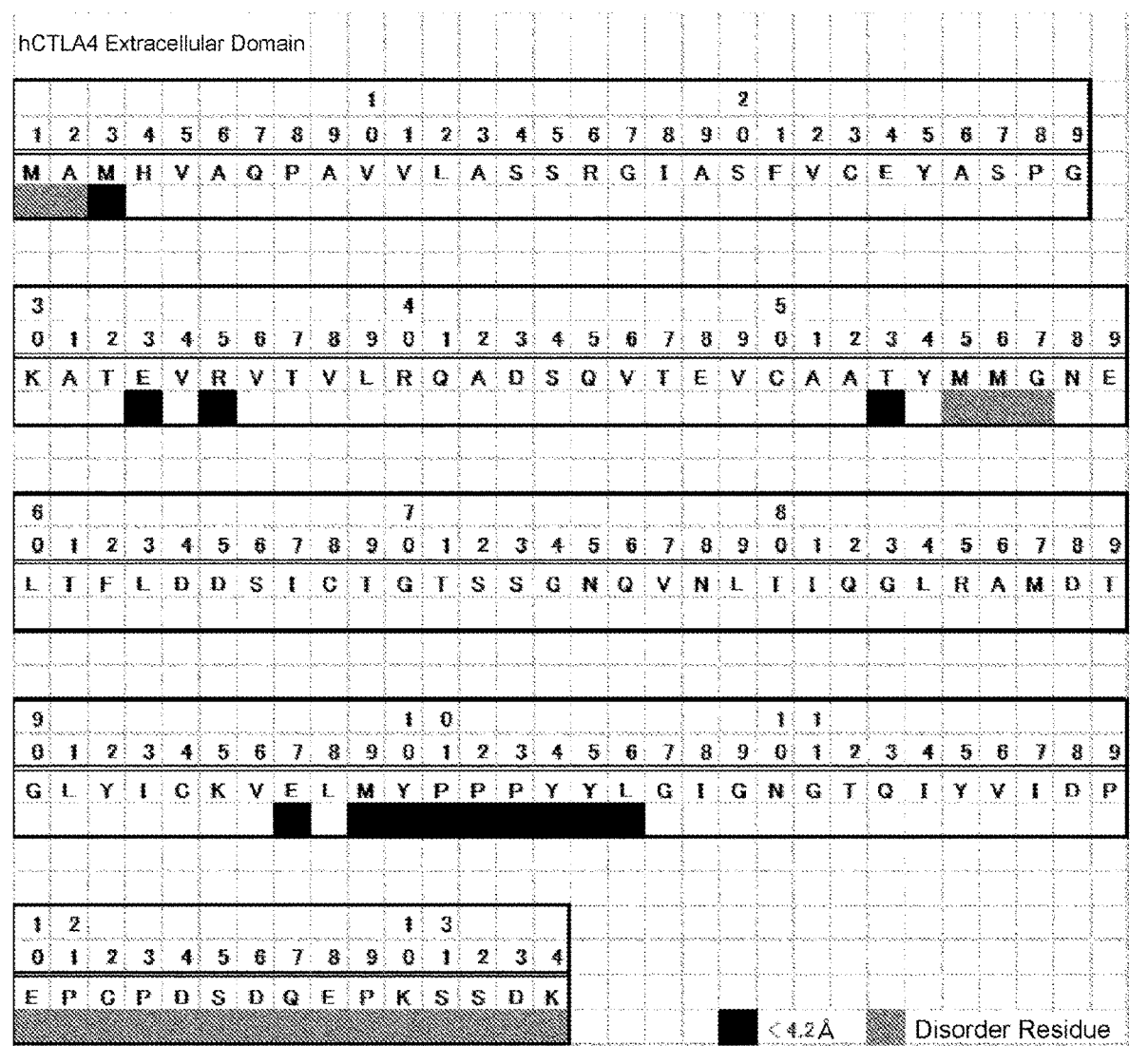

In FIGS. 23 and 24, the epitopes of the ABAM004 Fab contact region are mapped within the hCTLA4 crystal structure and in the amino acid sequence, respectively. The epitopes contain amino acid residues of hCTLA4 containing one or more non-hydrogen atoms located within 4.2 Å of either portion of ABAM004 Fab or AMP in the crystal structure.

It became clear from the crystal structure that at least the antigen's M3, E33, R35, T53, E97, M99, Y100, P101, P102, P103, Y104, Y105, and L106 are recognized by the heavy chain CDR2 and CDR3, and light chain CDR1 and CDR3 of the antibody, and AMP. In particular, the loop consisting of M99 to Y104 of the antigen is strongly recognized by the antibody in a manner buried in the CDR loop of the antibody, and it is considered that the loop plays a major role in the antigen recognition by the antibody.

(2-15) AMP-Dependent Antigen Binding Mechanism

Figure 25:
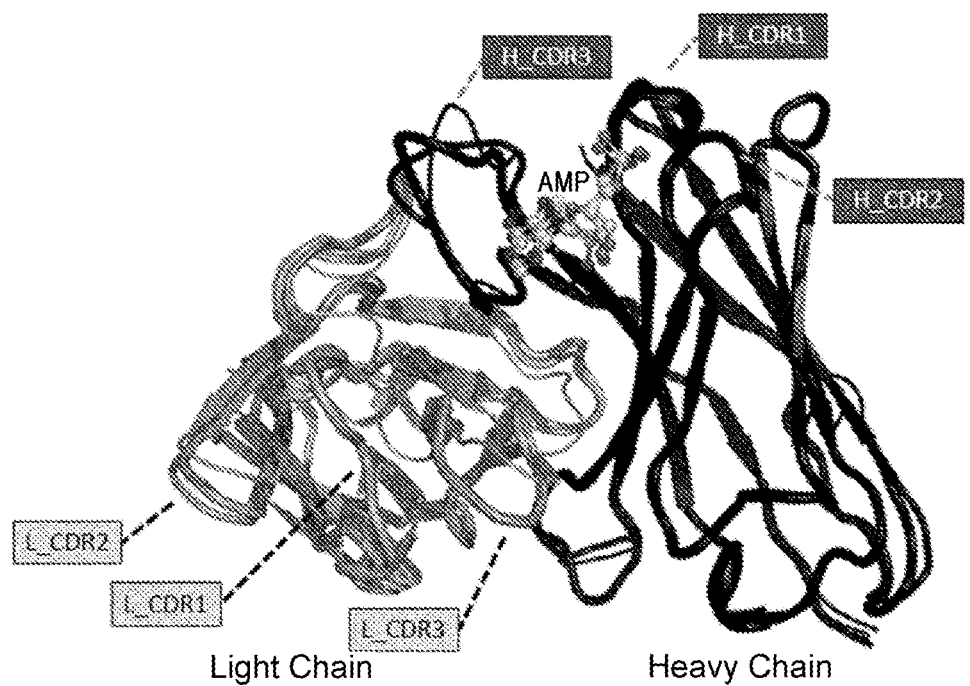
FIG. 25 is a superimposed figure of structures of the antibody and AMP extracted from the crystal structures of ABAM004 Fab fragment alone, a complex of ABAM004 Fab fragment and AMP, and a ternary complex of ABAM004 Fab fragment, AMP, and CTLA4, as described in Reference Example 2-15. In the figure, the heavy chain of the antibody is indicated in black, the light chain in gray, and AMP in a ball-and-stick model. The structure of ABAM004 Fab fragment alone is indicated by the thin line, the structure of the binary complex with AMP by the medium thick line, and the structure of the ternary complex by the thick line.

The variable region of the antibody was extracted from the crystal structure of ABAM004 Fab alone, the crystal structure of the complex of ABAM004 Fab and AMP, and the crystal structure of the ternary complex consisting of ABAM004 Fab, AMP and CTLA4, and FIG. 25 is a superimposed figure of the extracted variable regions centering around the heavy chain. For AMP-dependent antigen binding, not only the direct interaction between AMP and CTLA4 shown in Reference Example 2-14, but also the structural change of the antibody associated with AMP binding is considered to be important.

As shown in FIG. 25, by comparing the crystal structure of the antibody alone with the crystal structure of the antibody to which AMP binds, it was revealed that the loop structure of the heavy chain CDR3 and the light chain CDR3, as well as the angle of torsion between the heavy chain and the light chain in the variable regions of the antibody were also changed. Furthermore, comparing the crystal structure of the antibody to which AMP binds and the crystal structure of the ternary complex consisting of the antibody, AMP and CTLA4, it is also recognized that the structures of heavy chain CDR3 and light chain CDR1 were further changed by antigen-binding, showing antigen-dependent structural changes. On the other hand, since there was no change in the light chain CDR3 loop structure and the angle of torsion between the heavy chain and the light chain, it is thought that AMP binding may have changed the structure of the antibody to a state close to the structure at the time of antigen binding. Thus, it is thought that structural changes associated with AMP binding are necessary to form an appropriate structure for antigen binding, and play an important role in AMP-dependent antigen binding.

Reference Example 3

Generation of Altered CTLA4 Antibodies and Evaluation of their Activities (3-1) Generation of CTLA4-Binding Activity-Enhanced Variants of ABAM004 Antibody The amino acid sequence of ABAM004 (VH SEQ ID NO: 10, VL SEQ ID NO: 11) obtained from the human rational design phage library described in Reference Example 1 was altered to reduce the CTLA4-binding activity of said sequence in the absence of ATP analogs, to enhance the human CTLA4-binding activity in the presence of ATP analogs, and to enhance the binding to ATP and ATP analogs. In order to achieve this, variants with point mutations in residues expected to be involved in the bindings were generated based on the co-crystal structure of ABAM004 and AMP and the co-crystal structure of ABAM004, AMP and human CTLA4 obtained by the method described in Reference Example 2. Furthermore, variants in which every amino acid contained in CDRs was replaced with Ala or Pro were also generated. The point mutation variants were measured by Biacore T200 or Biacore 4000 (GE Healthcare) for human CTLA4 (Abatacept and hCTLA4-His-BAP)-binding activity in the absence of ATP and in the presence of ATP, ADP or AMP, to screen mutations which enhance the binding activity. Variant were prepared by combining mutations which enhanced the binding activity, and the KD value was calculated by Biacore. As a result, it was clarified that introducing substitutions of H32A and S52aT into the heavy chain of ABAM004 and T24D, T26P, and E50F into the light chain (according to Kabat numbering) enhanced the binding property of ABAM004. The variant is referred to as 04H0150/04L0072 (VH SEQ ID NO: 47, VL SEQ ID NO: 48).

(3-2) Measurement of the Effect of ATP and its Metabolites on the Human CTLA4-Binding Activity of ABAM004 and 04H0150/04L0072 by Surface Plasmon Resonance First, a chip was created for Biacore T200 measurement. The temperature of Biacore T200 was set to 25° C. and the flow rate was set to 10 µL/min. HBS-EP+ was used as the running buffer. A mixture of equal volumes of NHS (N-hydroxysuccinimide) and EDC (N-ethyl-N'-(dimethylaminopropyl)carbodiimide) was added to Sensor chip CM5 (GE Healthcare) at a flow rate of 10 µL/min for 10 minutes to activate flow cells. Next, 25 µg/mL Protein A/G (Pierce) suspended in 10 mM sodium acetate pH 4.0 was added and allowed to bind at 10 µL/min for 30 minutes. The excess active groups on the flow cells were then blocked by adding 1 M ethanolamine-HCl at 10 µL/min for 10 minutes.

Figure 26:
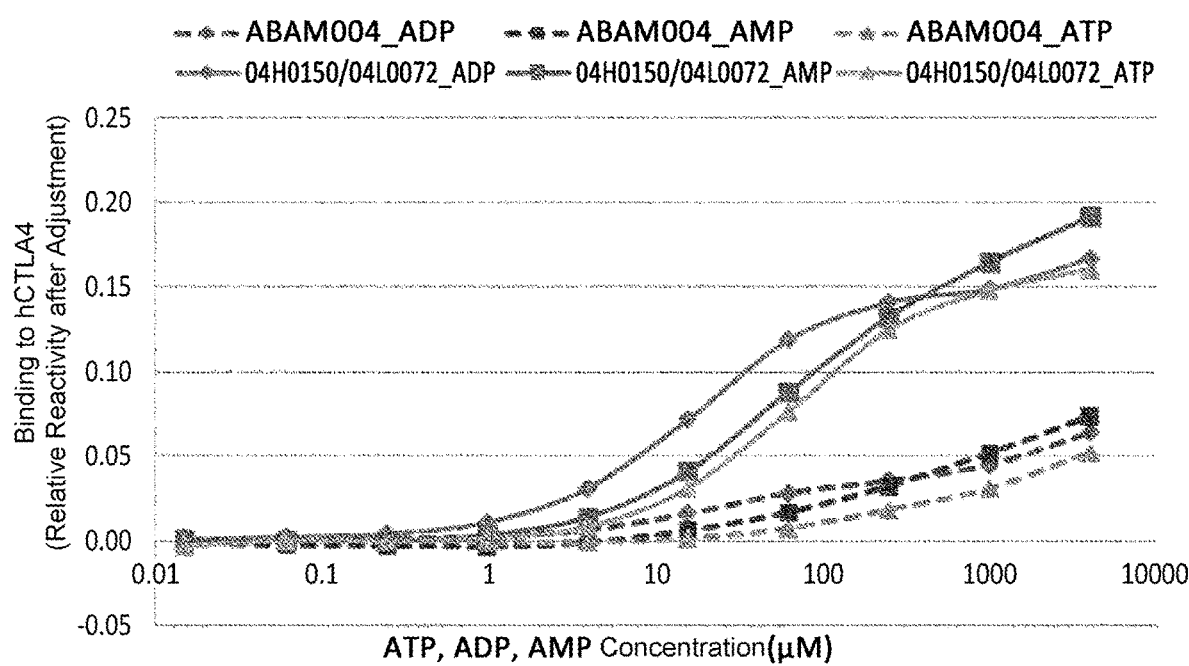
FIG. 26 shows the binding activity of the anti-CTLA-4 antibody ABAM004 and its variant, 04H0150/04L0072, to CTLA-4, which binding activity depends on the concentration of ATP, ADP, or AMP as described in Reference Example 3-2. As notations in the figure, WT and H150L072 indicate ABAM004 and 04H0150/04L0072, respectively.

Next, the effect of ATP and its metabolites on the binding of the target antibody to human CTLA4 was measured. The set temperature was 25° C., and TBS was used as the running buffer. 10 mM Glycine-HCl (pH 1.5) was used as the regeneration solution. After the antibody suspended in TBS was allowed to capture, each flow cell was injected with a TBS solution containing 500 nM hCTLA4-His-BAP, 10 concentrations of ATP, ADP or AMP diluted at a common ratio of 4 from 4000 µM, and 2 mM $MgCl_2$ at a flow rate of 10 µL/min for 3 minutes. These 3 minutes were used as the binding phase of hCTLA4-His-BAP. After the completion of the binding phase, the injection was switched to the running buffer for 2 minutes, which were used as the dissociation phase. After the dissociation phase was completed, the regeneration solution was injected at a flow rate of 30 µL/min for 30 seconds, and the above was taken as the binding activity measurement cycle. The binding amount of hCTLA4-His-BAP that interacted with ABAM004 or 04H0150/04L0072 in the binding phase was corrected with the amount of captured antibody. The results are shown in FIG. 26. In addition, in the binding measurement of ABAM004 and 04H0150/04L0072, the small molecule concentration in the binding phase was maintained at 62.5 µM or 1 mM, and 8 concentrations of hCTLA4-His-BAP diluted at a common ratio of 2 from 2000 nM were used in the binding phase. The KD values obtained from the analysis of the binding amount of hCTLA4-His-BAP are shown in Table 24. Biacore T200 Evaluation Software Version: 2.0 and Microsoft Excel 2013 (Microsoft) were used to analyze and plot the data. A steady state affinity model was used to calculate the KD value.

TABLE 24

| | | KD (M) | |
|---|---|---|---|
| Ligand | Test sample | SM 62.5 µM | SM 1 mM |
| 04H0150/04L0072 | hCTLA4__AMP | 6.9E−07 | 2.3E−07 |
| | hCTLA4__ADP | 4.2E−07 | 3.2E−07 |
| | hCTLA4__ATP | 8.1E−07 | 3.2E−07 |
| ABAM004 | hCTLA4__AMP | 4.3E−06 | 1.4E−06 |
| | hCTLA4__ADP | 2.5E−06 | 1.5E−06 |
| | hCTLA4__ATP | 5.5E−06 | 2.3E−06 |

SM represents the small molecule (ATP, ADP or AMP) used in each assay.

(3-3) Enhancement of Binding Ability by Introducing Comprehensive Alterations

In order to generate better anti-CTLA4 antibodies, amino acid alterations were comprehensively introduced into 04H0150/04L0072, which are variable regions of the anti-human CTLA4 antibody prepared in Reference Example 3-1. Variants in which amino acid substitution to every 18 amino acid except cysteine was conducted in all CDRs of 04H0150 and 04L0072 were generated by methods known to those skilled in the art such as PCR. Measurements of about 1200 variants generated for binding to human CTLA4 were performed using Biacore 4000. Protein A/G (Thermo Fisher Scientific) was immobilized onto a Series S Sensor Chip CM5 (GE Healthcare), and antibodies were captured onto the chip by interacting the culture supernatant containing an antibody variant. Next, a human CTLA4 solution to which a small molecule (ATP, ADP, or AMP) was added or a human CTLA4 solution to which a small molecule was not added was allowed to interact with the antibody to evaluate the binding ability of the antibody to human CTLA4 in the presence or absence of the small molecule. Assay was performed at 25° C. using Tris buffered saline, 0.02% PS20 as the running buffer.

Alterations that enhanced the binding to human CTLA4 in the presence of a small molecule and alterations that reduced the binding to human CTLA4 in the absence of the small molecule, the alterations being found using the above method, were combined to generate anti-human CTLA4 antibodies showing better profiles. To the antibody heavy chain 04H0150-G1m (SEQ ID NO: 209) gene, which has 04H0150 as the heavy chain variable region and G1m (SEQ ID NO: 82) in which the C-terminal Gly and Lys of human IgG1 have been removed as the heavy chain constant region, alterations found by the introduction of comprehensive alterations and alterations to the framework were combined to prepare antibody heavy chain genes. To the antibody light chain 04L0072-lam1 (SEQ ID NO: 208) having 04L0072 as the light chain variable region and human λ chain lam1 (SEQ ID NO: 87) as the light chain constant region, the found alterations were combined to generate antibody light chain genes. Furthermore, a variant in which the framework of the light chain variable region and the constant region were replaced with the sequence of the human κ chain was also generated. For comparison, the gene for the antibody heavy chain MDX10D1H-G1m (SEQ ID NO: 210) having the heavy chain variable region MDX10D1H (SEQ ID NO: 154) and the gene for the antibody light chain MDX10D1L-k0MT (SEQ ID NO: 211) having the light chain variable region MDX10D1L (SEQ ID NO: 155) of the existing anti-human CTLA4 antibody described in WO 0114424 were generated. Antibodies were expressed and purified by a method known to those skilled in the art by combining these genes to generate anti-CTLA4 antibodies of interest. Table 25 lists SEQ ID NOs of the heavy chain variable regions, light chain variable regions, heavy chain constant regions, light chain constant regions, and hypervariable regions of the generated antibodies. The antibodies herein are named according to the following rule: (heavy chain variable region)–(heavy chain constant region)/(light chain variable region)–(light chain constant region). For example, it means that if the antibody name is 04H0150-G1m/04L0072-lam1, the heavy chain variable region of this antibody is 04H0150, the heavy chain constant region is G1m, the light chain variable region is 04L0072, and the light chain constant region is lam1.

Amino acid sequences of heavy chains, light chains, and their hypervariable regions (indicated by SEQ ID NO:)

Biacore T200 was used to measure the binding of the generated antibodies to human CTLA4. 20 mM ACES (pH 7.4), 150 mM NaCl, 2 mM $MgCl_2$, 0.05% Tween 20 with ATP added to the desired concentration was used as the running buffer, and the assay was performed at 37° C. First, Protein G (CALBIOCHEM) was immobilized onto a Series S Sensor Chip CM3 (GE Healthcare), and the antibodies were captured by interacting an antibody solution prepared in an ATP-free running buffer with the chip. Next, by interacting with a human CTLA4 solution prepared in a running buffer containing ATP to the desired concentration, or a human CTLA4 solution prepared in a running buffer containing no ATP, the binding ability of the antibody to human CTLA4 in the presence or absence of ATP was evaluated. Chips were regenerated with 25 mM NaOH and 10 mM Glycine-HCl (pH 1.5), and assay was performed by repeatedly capturing antibodies. The dissociation constant of each antibody for CTLA4 was calculated using Biacore T200 Evaluation Software 2.0. Specifically, the binding rate constant ka (L/mol/s) and the dissociation rate constant kd (1/s) were calculated by global fitting of the sensorgrams obtained by the measurement, using a 1:1 Langmuir binding model. The dissociation constant KD (mol/L) was calculated from those values. Alternatively, the dissociation constant KD (mol/L) was calculated by the steady state model. In addition, the binding amount of CTLA4 per unit amount of antibody was calculated by correcting the amount of CTLA4 bound as calculated from the sensorgram obtained by the assay with the amount of antibody captured onto the chip surface. Table 26 shows the results of these assay.

TABLE 25

| Antibody name | Variable Region | | Constant Region | | Hyper Variable Region (HVR) | | | | | |
|---|---|---|---|---|---|---|---|---|---|---|
| | Heavy Chain | Light Chain | Heavy Chain | Light Chain | H1 | H2 | H3 | L1 | L2 | L3 |
| 04H0150-G1m/04L0072-lam1 | 98 | 99 | 82 | 87 | 103 | 104 | 102 | 116 | 117 | 115 |
| 04H1077-G1m/04L1041-lam1 | 83 | 88 | 82 | 87 | 105 | 106 | 102 | 118 | 117 | 115 |
| 04H1077-G1m/04L1063-lam1 | 83 | 89 | 82 | 87 | 105 | 106 | 102 | 116 | 117 | 133 |
| 04H1077-G1m/04L1027-lam1 | 83 | 90 | 82 | 87 | 105 | 106 | 102 | 119 | 117 | 115 |
| 04H1077-G1m/04L1034-lam1 | 83 | 91 | 82 | 87 | 105 | 106 | 102 | 120 | 117 | 115 |
| 04H1077-G1m/04L1066-lam1 | 83 | 92 | 82 | 87 | 105 | 106 | 102 | 121 | 117 | 115 |
| 04H1077-G1m/04L1067-lam1 | 83 | 93 | 82 | 87 | 105 | 106 | 102 | 122 | 117 | 115 |
| 04H1077-G1m/04L1068-lam1 | 83 | 94 | 82 | 87 | 105 | 106 | 102 | 118 | 117 | 133 |
| 04H1077-G1m/04L1086-lam1 | 83 | 97 | 82 | 87 | 105 | 106 | 102 | 122 | 117 | 133 |
| 04H1077-G1m/04L1305-k0MT | 83 | 95 | 82 | 96 | 105 | 106 | 102 | 122 | 117 | 133 |
| 04H1206-G1m/04L1086-lam1 | 84 | 97 | 82 | 87 | 105 | 106 | 102 | 122 | 117 | 133 |
| 04H1207-G1m/04L1086-lam1 | 85 | 97 | 82 | 87 | 107 | 106 | 102 | 122 | 117 | 133 |
| 04H1208-G1m/04L1086-lam1 | 86 | 97 | 82 | 87 | 107 | 108 | 102 | 122 | 117 | 133 |
| 04H1208-G1m/04L1407-k0MT | 86 | 134 | 82 | 96 | 107 | 108 | 102 | 121 | 123 | 153 |

Binding analysis of altered antibody to human CTLA4

TABLE 26

| Antibody name | Binding to Human CTLA4 | | | | $K_D$ for Human CTLA4 (M) | | |
|---|---|---|---|---|---|---|---|
| | No ATP | ATP = 1 μM | ATP = 10 μM | ATP = 100 μM | No ATP | ATP = 10 μM | ATP = 100 μM |
| MDX10D1H-G1m/MDX10D1L-k0MT | 0.189 | 0.189 | 0.181 | 0.170 | 4.8E−08 | 4.9E−08 | 4.5E−08 |
| 04H0150-G1m/04L0072-lam1 | 0.001 | 0.001 | 0.010 | 0.056 | N.A. | N.A. | 1.9E−06 |
| 04H1077-G1m/04L1041-lam1 | 0.006 | 0.023 | 0.094 | 0.172 | N.A. | 7.3E−07 | 1.4E−07 |
| 04H1077-G1m/04L1063-lam1 | 0.001 | 0.003 | 0.029 | 0.105 | N.A. | N.A. | 5.8E−07 |
| 04H1077-G1m/04L1027-lam1 | 0.000 | 0.001 | 0.024 | 0.099 | N.A. | N.A. | 6.7E−07 |
| 04H1077-G1m/04L1034-lam1 | 0.004 | 0.007 | 0.041 | 0.114 | N.A. | N.A. | 3.2E−07 |
| 04H1077-G1m/04L1066-lam1 | 0.020 | 0.057 | 0.142 | 0.185 | *6.9E−06 | 2.8E−07 | 4.8E−08 |
| 04H1077-G1m/04L1067-lam1 | 0.012 | 0.041 | 0.131 | 0.192 | N.A. | 4.0E−07 | 7.6E−08 |
| 04H1077-G1m/04L1068-lam1 | 0.005 | 0.018 | 0.080 | 0.165 | N.A. | 8.8E−07 | 1.5E−07 |
| 04H1077-G1m/04L1086-lam1 | 0.010 | 0.031 | 0.106 | 0.181 | N.A. | 6.9E−07 | 1.1E−07 |
| 04H1077-G1m/04L1305-k0MT | 0.018 | 0.046 | 0.128 | 0.185 | *6.5E−06 | 3.6E−07 | 5.6E−08 |
| 04H1206-G1m/04L1086-lam1 | 0.010 | 0.029 | 0.103 | 0.179 | N.A. | 6.8E−07 | 1.2E−07 |
| 04H1207-G1m/04L1086-lam1 | 0.013 | 0.047 | 0.137 | 0.196 | N.A. | 3.3E−07 | 5.9E−08 |
| 04H1208-G1m/04L1086-lam1 | 0.005 | 0.030 | 0.108 | 0.170 | N.A. | 4.5E−07 | 7.4E−08 |
| 04H1208-G1m/04L1407-k0MT | 0.138 | 0.175 | 0.200 | 0.214 | *4.3E−07 | 2.3E−08 | 6.2E−09 |

N.A.; Extremely weak for determining KD value
*KD value was determined by the steady state model.

The value of "Binding to Human CTLA4" in the table indicates the binding amount of human CTLA4 per unit amount of antibody when human CTLA4 was allowed to interact at 1000 nM under each of the listed ATP concentration conditions, and "KD for Human CTLA4 (M)" indicates the dissociation constant for human CTLA4 under each ATP concentration condition. The KD values marked with an * in the table were calculated using the steady state model. It was shown that all the variants prepared using 04H0150-G1m/04L0072-lam1 as the parent antibody had enhanced binding in the presence of ATP as compared to 04H0150-G1m/04L0072-lam1. In addition, as 04H0150-G1m/04L0072-lam1 and these variants had a higher binding amount under the condition when ATP was present at 10 μM than at 1 μM; and the binding amount in the presence of 100 μM was further higher, binding to human CTLA4 in an ATP concentration-dependent manner was observed. On the other hand, the comparative MDX10D1H-G1m/MDX10D1L-k0MT did not show such ATP concentration-dependent binding to human CTLA4. Though 04H1077-G1m/04L1305-k0MT in which 04H1077-G1m/04L1086-lam1's light chain framework and constant region were replaced with human κ chain had enhanced binding to human CTLA4 in the absence of ATP compared to 04H1077-G1m/04L1086-lam1, ATP concentration-dependent binding was also enhanced. These results showed that the property of binding to human CTLA4 in an ATP-dependent manner is maintained even when the sequence was replaced with human κ chain sequence. Among the antibodies generated here, 04H1077-G1m/04L1066-lam1, 04H1077-G1m/04L1305-k0MT, and 04H1207-G1m/04L1086-lam1 showed almost the same binding activity as the existing anti-human CTLA4 antibody MDX10D1H-G1m/MDX10D1L-k0MT under the condition when ATP was present at 100 μM, and 04H1208-G1m/04L1407-k0MT showed stronger binding activity than MDX10D1H-G1m/MDX10D1L-k0MT under the condition when ATP was present at 10 μM or more.

Next, among the antibodies prepared in Table 26, the binding of 04H1077-G1m/04L1086-lam1 and 04H1208-G1m/04L1407-k0MT to mouse CTLA4 was evaluated. For comparison, the gene for the antibody heavy chain hUH02-G1d (SEQ ID NO: 212) having the heavy chain variable region hUH02 (SEQ ID NO: 156) of the anti-mouse CTLA4 antibody and the gene for antibody light chain hUL01-k0 (SEQ ID NO: 213) having the light chain variable region hUL01 (SEQ ID NO: 157) were generated, and the antibody was expressed, purified and used. Assay was performed using Biacore T200 under the same conditions as the measurement of binding to human CTLA4, except for using mouse CTLA4 as a sample (Table 27). Mouse CTLA4 was prepared as follows.

The gene of a mouse CTLA4 extracellular region linked with a His-tag (mCTLA4-His) (SEQ ID NO: 49) was synthesized and inserted into an animal expression plasmid. The prepared plasmid was introduced by the lipofection method into the human embryonic kidney cell-derived Free-Style 293-F line (Invitrogen), which had been seeded in a flask following suspension in the FreeStyle 293 Expression Medium (Invitrogen) at a cell density of 1.33×10⁶ cells/mL. The absorbance of the purified antigen solution at 280 nm was measured using a spectrophotometer. From the obtained measured values, the concentration of the purified antigen was calculated using the extinction coefficient calculated by the PACE method (Protein Science (1995) 4, 2411-2423).

Binding analysis of altered antibodies to mouse CTLA4

TABLE 27

| Antibody name | Binding to Mouse CTLA4 | | | | $K_D$ for Mouse CTLA4 (M) | |
|---|---|---|---|---|---|---|
| | No ATP | ATP = 1 μM | ATP = 10 μM | ATP = 100 μM | ATP = 10 μM | ATP = 100 μM |
| hUH02-G1d/hUL01-k0 | 0.155 | 0.160 | 0.159 | 0.157 | 1.1E−07 | 1.1E−07 |
| 04H1077-G1m/04L1086-lam1 | N.D. | 0.001 | 0.024 | 0.093 | 4.1E−06 | 5.9E−07 |
| 04H1208-G1m/04L1407-k0MT | 0.023 | 0.099 | 0.153 | 0.175 | 8.4E−08 | 1.6E−08 |

N.D.; Extremely weak for detecting binding

The value of "Binding to mouse CTLA4" in the table indicates the binding amount of mouse CTLA4 per unit amount of antibody when mouse CTLA4 was allowed to interact at 1000 nM under each of the listed ATP concentration conditions, and "KD for mouse CTLA4 (M)" indicates the dissociation constant for mouse CTLA4 under each ATP concentration condition. hUH02-G1d/hUL01-k0 was shown to bind to mouse CTLA4 to the same extent regardless of ATP concentration, whereas both 04H1077-G1m/04L1086-lam1 and 04H1208-G1m/04L1407-k0MT were shown to bind to mouse CTLA4 in an ATP concentration-dependent manner. Compared to the binding ability to human CTLA4 shown in Table 26, the binding ability of 4H1077-G1m/04L1086-lam1 to mouse CTLA4 was about 5 times weaker compared to the binding ability to human CTLA4, and the binding ability of 04H1208-G1m/04L1407-k0MT to mouse CTLA4 was about twice weaker compared to the binding ability to human CTLA4, in the presence of 100 µM ATP.

(3-4) Generation of an Anti-mCTLA4 Control Antibody and Anti-mCTLA4 Switch Antibodies An anti-mCTLA4 control antibody (hUH02-mFa55/hUL01-mk1, abbreviation: mNS-mFa55) and anti-CTLA4 switches (04H1077-mFa55/04L1086-ml0r, abbreviation: SW1077-mFa55; and 04H1208-mFa55/04L1407s-mk1, abbreviation: SW1208-mFa55) were generated. In the mNS-mFa55 antibody, the heavy chain variable region hUH02 (SEQ ID NO: 16) and the light chain variable region hUL01 (SEQ ID NO: 17) were used, and for the constant regions, the mouse heavy chain constant region mFa55 (SEQ ID NO: 18) and the wild type mouse light chain constant region mk1 (SEQ ID NO: 19) were used. At this time, a mouse heavy chain constant region to which alterations were added to enhance binding to the Fcγ receptor was used. The antibody was expressed and purified by a method known to those skilled in the art.

In the SW1077-mFa55 antibody, the heavy chain variable region 04H1077 (SEQ ID NO: 20) and the light chain variable region 04L1086 (SEQ ID NO: 21) were used, and for the constant regions, the mouse heavy chain constant region mFa55 (SEQ ID NO: 18) and the wild type mouse light chain constant region ml0r (SEQ ID NO: 22) were used. At this time, a mouse heavy chain constant region to which alterations were added to enhance binding to the Fcγ receptor was used. The antibody was expressed and purified by a method known to those skilled in the art. In the SW1208-mFa55 antibody, the heavy chain variable region 04H1208 (SEQ ID NO: 23) and the light chain variable region 04L1407s (SEQ ID NO: 24) were used, and for the constant regions, the mouse heavy chain constant region mFa55 (SEQ ID NO: 18) and the wild type mouse light chain constant region mk1 (SEQ ID NO: 19) were used. At this time, a mouse heavy chain constant region to which alterations were added to enhance binding to the Fcγ receptor was used. The antibody was expressed and purified by a method known to those skilled in the art.

(3-6) Evaluation of the Neutralizing Activity of a CTLA4 Switch Antibody

The neutralizing activity of an anti-CTLA4 switch antibody (SW1077-mFa55) prepared in Reference Example 3-4 was evaluated by the competitive ELISA method. mCTLA4-Fc (SEQ ID NO: 25) in which the human constant region was linked to mCTLA4 was diluted to 5 µg/mL (55 nM) with 0.1 M NaHCO$_3$, 0.05% NaN$_3$ to prepare a mCTLA4-Fc solution. 100 µL each of the prepared mCTLA4-Fc solution was added to a 96-well plate, and the plate was left to stand at 4° C. overnight to immobilize mCTLA4-Fc onto the plate surface. After washing 3 times with TBS, 0.1% Tween 20, 250 µL of BSA solution diluted to 2% with TBS was added to each well to perform blocking of the plate surface. After that, the plate was washed 3 times. mCD86-Fc-His (Sino Biologics Inc. 50068-M03H, Accession No. NP_062261.3) in which the human constant region and His-tag were fused to mouse CD86 diluted with TBS to the final concentration of 55 nM, SW1077-mFa55 antibody solution diluted to a final concentration of 6.25, 1.56, 0.390, 0.0977, 0.0061, and 0 µg/mL, and ATP solution diluted to a final concentration of 0, 1, 10, and 100 µM were each mixed so as to have a total of 100 µL, the mixture was added to each well, and the plate was left to stand at 37° C. for 1 hour. Each well was then washed 3 times with TBS, 0.1% Tween 20, prepared to contain the same ATP concentration as the solution added to each well. 100 µL of anti-His-tag mAb-HRP-Direct (MBL Life Sciences) diluted 10000 times with blocking buffer so as to contain the same ATP concentration as the solution added to each well was added to each well, and the plate was left to stand at 37° C. for 1 hour. Each well was then washed 3 times with TBS, 0.1% Tween 20, prepared to contain the same ATP concentration as the solution added to each well. 100 µL of TMB solution was added to each well, and the plate was left to stand at 37° C. for 1 hour. 50 µL of 1 M H$_2$SO$_4$ was added to each well to stop the reaction, and the absorbance at 450 nm was detected with an absorbance microplate reader (Wako Sunrise).

Figure 27:
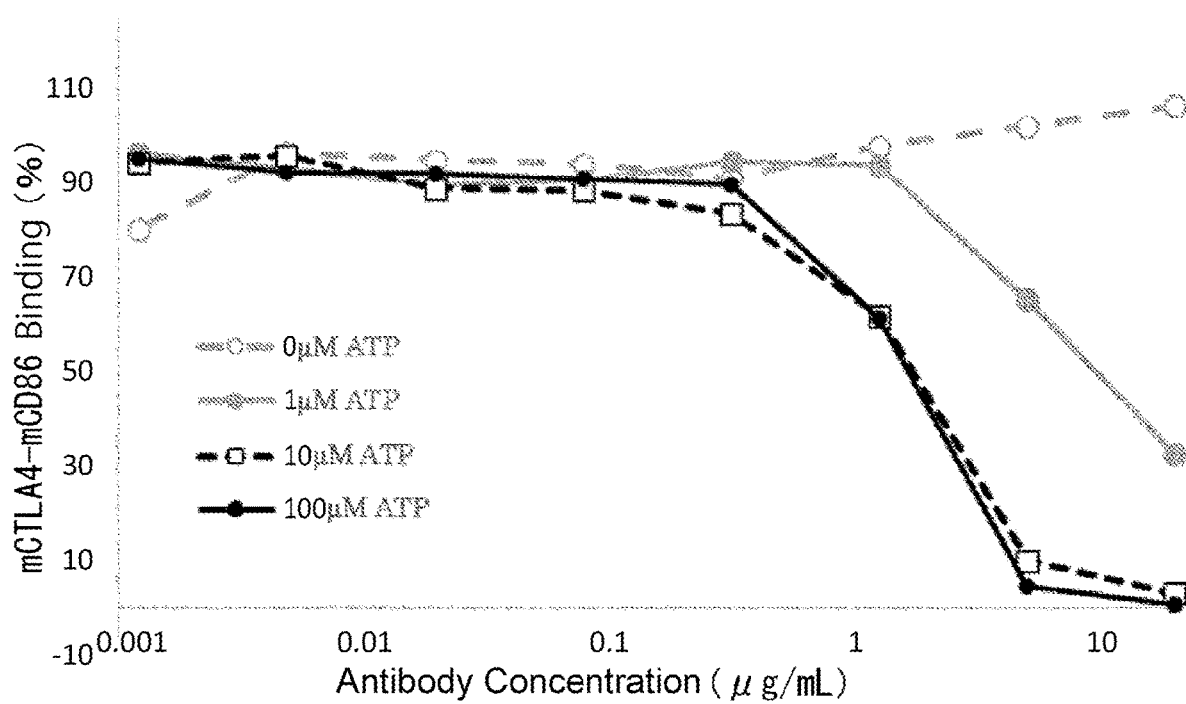
FIG. 27 shows the neutralizing activity of the anti-CTLA-4 antibody SW1077 against CTLA-4, which neutralizing activity depends on the concentration of ATP as described in Reference Example 3-6.

The absorbance value of antibody-free wells under the same ATP concentration condition was taken as mCTLA4-mCD86 binding rate of 100%, and how much the binding rate was reduced by antibody addition was evaluated. The results are shown in FIG. 27.

From these results, it was shown that the neutralizing activity of the SW1077 antibody against the interaction of mCTLA4-mCD86 becomes stronger as the ATP concentration in the assay increases. These results confirmed that the SW1077 antibody has ATP-dependent neutralizing activity.

(3-7) Efficacy of an Anti-CTLA4 Switch Antibody in Syngeneic Tumor Cell-Transplanted Mouse Model, Increase/Decrease of Regulatory T (Treg) Cells in Tumor, and Change of Systemic Response Marker in Spleen (3-7-1) Preparation of Cell Line and Syngeneic Tumor Line-Transplanted Mouse Model The cells used were mouse breast cancer line FM3A cells purchased from RIKEN. FM3A cells were maintained and passaged in RPMI 1640 medium (Sigma) containing 10% bovine serum (Thermo Fisher Scientific). As mice, C3H/HeN mice (7-week-old, female) purchased from Charles River Laboratories, Japan were used. FM3A cells were transplanted under the abdominal skin of mice, and the model was determined to be established when the volume of the transplanted tumor became from about 150 mm$^3$ to about 300 mm$^3$.

The volume of the transplanted tumor was calculated by the following formula.

Tumor volume=long diameter×short diameter×short diameter/2

(3-7-2) Preparation of Drugs for Administration

The drugs to be administered to the FM3A cell-transplanted model were the anti-mouse CTLA4 control antibody (mNS-mFa55) and the anti-CTLA4 switch antibody (SW1208-mFa55) prepared in Reference Example 3-4. Using His-buffer (20 mM His-HCl, 150 mM NaCl, pH 6.0), mNS-mFa55 was prepared to be 0.0005 mg/mL, 0.005 mg/mL, 0.0125 mg/mL, 0.05 mg/mL, 0.5 mg/mL, 1.5 mg/mL, and 5 mg/mL, and SW1208-mFa55 was prepared to be 0.005 mg/mL, 0.05 mg/mL, 0.5 mg/mL, 5 mg/mL, and 25 mg/mL, respectively.

(3-7-3) Drug Administration for Measuring Antitumor Effect

On the 9th day after transplantation, mNS-mFa55 was administered to mice at doses of 0.01 mg/kg, 0.1 mg/kg, 0.25 mg/kg, 1 mg/kg, 10 mg/kg, 30 mg/kg, and 100 mg/kg, and SW1208-mFa55 was administered at doses of 0.1 mg/kg, 1 mg/kg, 10 mg/kg, 100 mg/kg, and 500 mg/kg, respectively. The prepared solutions for administration were administered at a dose of 20 mL/kg via the tail vein. Table 28 shows the details of drug treatment when measuring the antitumor effect.

Measurement of the antitumor effect in FM3A cell-transplanted model

TABLE 28

| Group | Heads | Drug | Dose | Administration route | Administration date |
|---|---|---|---|---|---|
| 1 | 4 | His-buffer | — | Tail Vein | 9th day after transplantation |
| 2 | 4 | mNS-mFa55 | 0.01 mg/kg | Tail Vein | 9th day after transplantation |
| 3 | 4 | mNS-mFa55 | 0.1 mg/kg | Tail Vein | 9th day after transplantation |
| 4 | 4 | mNS-mFa55 | 0.25 mg/kg | Tail Vein | 9th day after transplantation |
| 5 | 4 | mNS-mFa55 | 1 mg/kg | Tail Vein | 9th day after transplantation |
| 6 | 4 | mNS-mFa55 | 10 mg/kg | Tail Vein | 9th day after transplantation |
| 7 | 4 | mNS-mFa55 | 30 mg/kg | Tail Vein | 9th day after transplantation |
| 8 | 4 | mNS-mFa55 | 100 mg/kg | Tail Vein | 9th day after transplantation |
| 9 | 4 | SW1208-mFa55 | 0.1 mg/kg | Tail Vein | 9th day after transplantation |
| 10 | 4 | SW1208-mFa55 | 1 mg/kg | Tail Vein | 9th day after transplantation |
| 11 | 4 | SW1208-mFa55 | 10 mg/kg | Tail Vein | 9th day after transplantation |
| 12 | 4 | SW1208-mFa55 | 100 mg/kg | Tail Vein | 9th day after transplantation |
| 13 | 4 | SW1208-mFa55 | 500 mg/kg | Tail Vein | 9th day after transplantation |

(3-7-4) Evaluation of Antitumor Effect

The antitumor effect was evaluated by the tumor volume calculated by the formula described in (3-7-1).

The tumor growth inhibition rate (TGI: Tumor Growth Inhibition) value was calculated by the following formula.

$$\text{TGI (\%)} = (1 - (\text{Mean tumor volume in the group of interest at the time of measurement} - \text{Mean tumor volume in the group of interest at the time of initial administration})/(\text{Mean tumor volume in the control group at the time of measurement} - \text{Mean tumor volume in the control group at the time of initial administration})) \times 100$$

Figure 28:
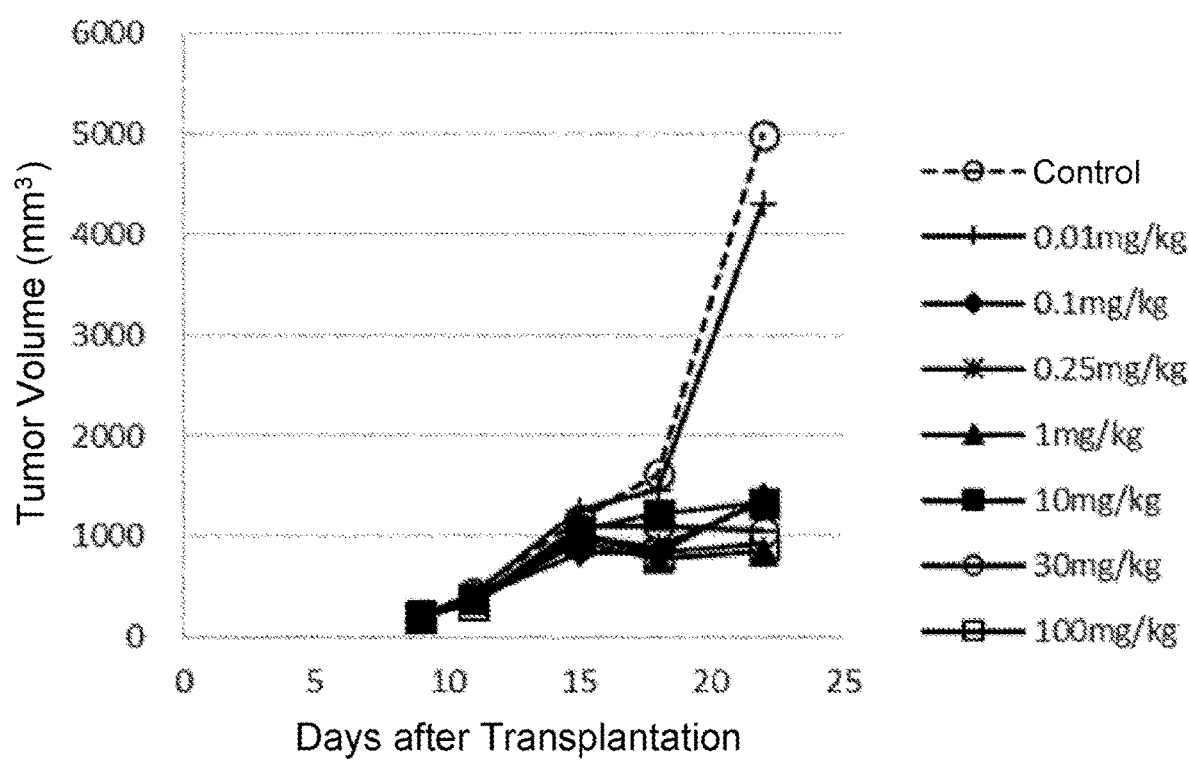
FIG. 28 shows the antitumor effect of the anti-CTLA-4 antibody mNS-mFa55 (control antibody) in a mouse model transplanted with the FM3A cell line, as described in Reference Example 3-7-4. The antibody was administered at 0.01 mg/kg, 0.1 mg/kg, 0.25 mg/kg, 1 mg/kg, 10 mg/kg, 30 mg/kg, and 100 mg/kg via the tail vein. Each point represents the mean tumor volume of a group, n=4.
Figure 29:
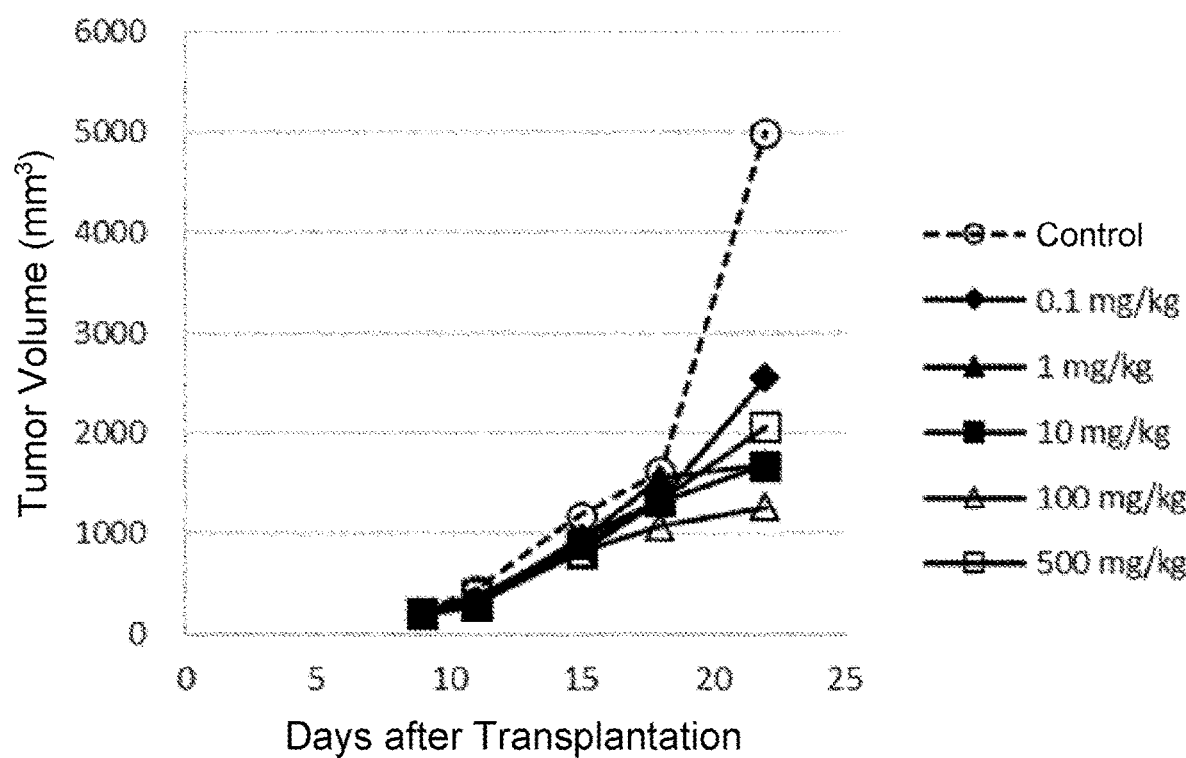
FIG. 29 shows the antitumor effect of the anti-CTLA-4 antibody SW1208-mFa55 (switch antibody) in a mouse model transplanted with the FM3A cell line, as described in Reference Example 3-7-4. The antibody was administered at 0.1 mg/kg, 1 mg/kg, 10 mg/kg, 100 mg/kg, and 500 mg/kg via the tail vein. Each point represents the mean tumor volume of a group, n=4.

As a result, a drug efficacy of TGI=60% or more on the 13th day after administration was shown for mNS-mFa55 at doses of 0.1 mg/kg or more and for SW1208-mFa55 at doses of 1 mg/kg or more (FIGS. 28 and 29).

(3-7-5) Drug Administration for Evaluation of Treg Cells in Tumor and Verification of Systemic Effects in Spleen On the 7th day after transplantation, the anti-mouse CTLA4 control antibody (mNS-mFa55) was administered via the tail vein at 0.1 mg/kg, 1 mg/kg, 10 mg/kg, and 100 mg/kg, and the anti-CTLA4 switch antibody (SW1208-mFa55) was administered via the tail vein at 0.1 mg/kg, 1 mg/kg, 10 mg/kg, 100 mg/kg, and 500 mg/kg. Table 29 shows details of drug treatment for evaluation of Treg cells in tumor and verification of systemic effects in the spleen.

Verification of intratumoral and systemic effects in FM3A cell-transplanted model (mNS-mFa55 and SW1208-mFa55)

TABLE 29

| Group | Heads | Drug | Dose | Administration route | Administration date |
|---|---|---|---|---|---|
| 1 | 3 | His buffer | — | Tail Vein | 7th day after transplantation |
| 2 | 3 | mNS-mFa55 | 0.1 mg/kg | Tail Vein | 7th day after transplantation |
| 3 | 3 | mNS-mFa55 | 1 mg/kg | Tail Vein | 7th day after transplantation |
| 4 | 3 | mNS-mFa55 | 10 mg/kg | Tail Vein | 7th day after transplantation |
| 5 | 3 | mNS-mFa55 | 100 mg/kg | Tail Vein | 7th day after transplantation |
| 6 | 3 | SW1208-mFa55 | 0.1 mg/kg | Tail Vein | 7th day after transplantation |
| 7 | 3 | SW1208-mFa55 | 1 mg/kg | Tail Vein | 7th day after transplantation |
| 8 | 3 | SW1208-mFa55 | 10 mg/kg | Tail Vein | 7th day after transplantation |
| 9 | 3 | SW1208-mFa55 | 100 mg/kg | Tail Vein | 7th day after transplantation |
| 10 | 3 | SW1208-mFa55 | 500 mg/kg | Tail Vein | 7th day after transplantation |

(3-7-6) Resection of Tumor and Spleen from FM3A Cell-Transplanted Model Mice

On the 6th day after the antibody administration, the mice were euthanized under anesthesia, and the tumor and spleen were resected. From the resected spleen, a cell suspension was prepared using RPMI-1640 medium (SIGMA) containing 10% FBS (SIGMA), and then hemolyzed using the Mouse Erythrocyte Lysing kit (R&D) to prepare spleen cells. The resected tumors were crushed using Tumor Dissociation Kt, mouse (Miltenyi). Both spleen cells and crushed tumors were reacted with the following antibodies, and the fractions of immune cells present were analyzed by FACS analysis: anti-CD45 antibody (BD, clone: 30-F11), anti-CD3 antibody (BD, clone: 145-2C11), anti-CD4 antibody (BD, clone: RM4-5), anti-FoxP3 antibody (eBioscience, clone: FJK-16s)), anti-ICOS antibody (eBioscience, clone: 7E17G9), anti-KLRG1 antibody (Biolegend, clone: 2F1/KLRG1). FACS analysis was performed by BD LSR Fortessa X-20 (BD).

(3-7-7) Tumor Treg Evaluation in FM3A Cell-Transplanted Model

Figure 30:
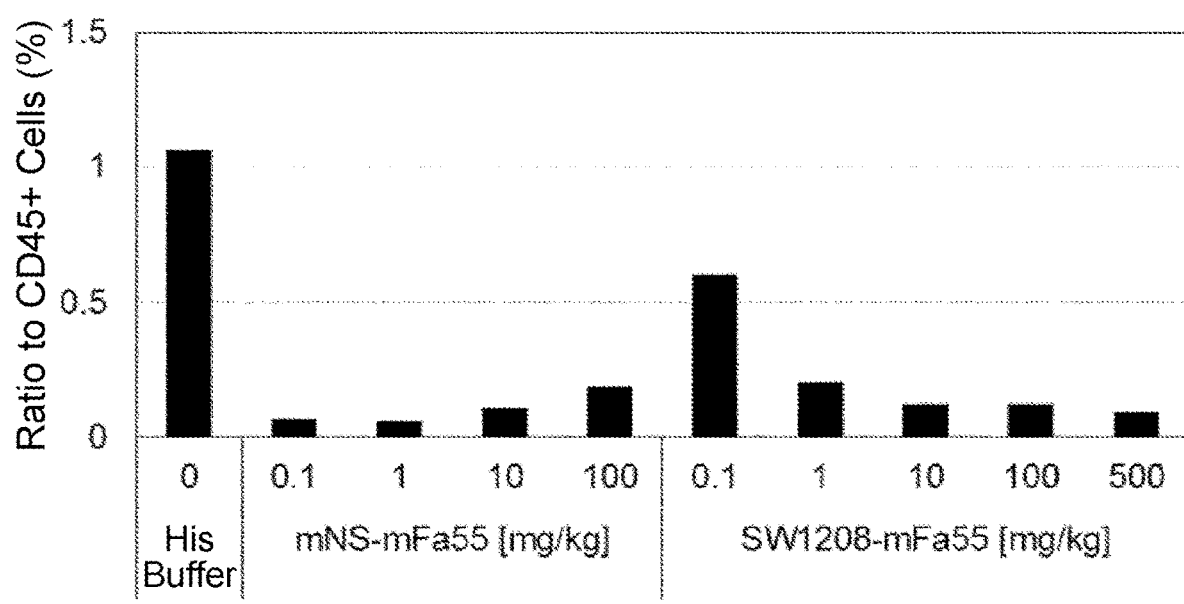
FIG. 30 shows the changes in the ratio of effector Treg cells in a tumor when the anti-CTLA-4 antibody mNS-mFa55 (control antibody) or SW1208-mFa55 (switch antibody) was administered in a mouse model transplanted with the FM3A cell line, as described in Reference Example 3-7-7. mNS-mFa55 was administered at 0.1 mg/kg, 1 mg/kg, 10 mg/kg, and 100 mg/kg via the tail vein, and SW1208-mFa55 was administered at 0.1 mg/kg, 1 mg/kg, 10 mg/kg, 100 mg/kg, and 500 mg/kg via the tail vein. The tumor was harvested six days after the administration, and the increase or decrease in effector Treg was evaluated by FACS analysis. The longitudinal axis is the ratio of effector Treg (CD4+ FoxP3+ KLRG1+) to CD45+ cells. The mean value of n=3 is shown.

Changes in effector Treg cells (CD4$^+$ FoxP3$^+$ KLRG1$^+$) in the tumor after administration of the anti-mouse CTLA4 control antibody (mNS-mFa55) or the anti-CTLA4 switch antibody (SW1208-mFa55) were evaluated. As a result, both mNS-mFa55 and SW1208-mFa55 reduced the ratio of effector Treg to less than 0.2% of CD45-positive cells at doses of 1 mg/kg and more (FIG. 30).

Figure 31:
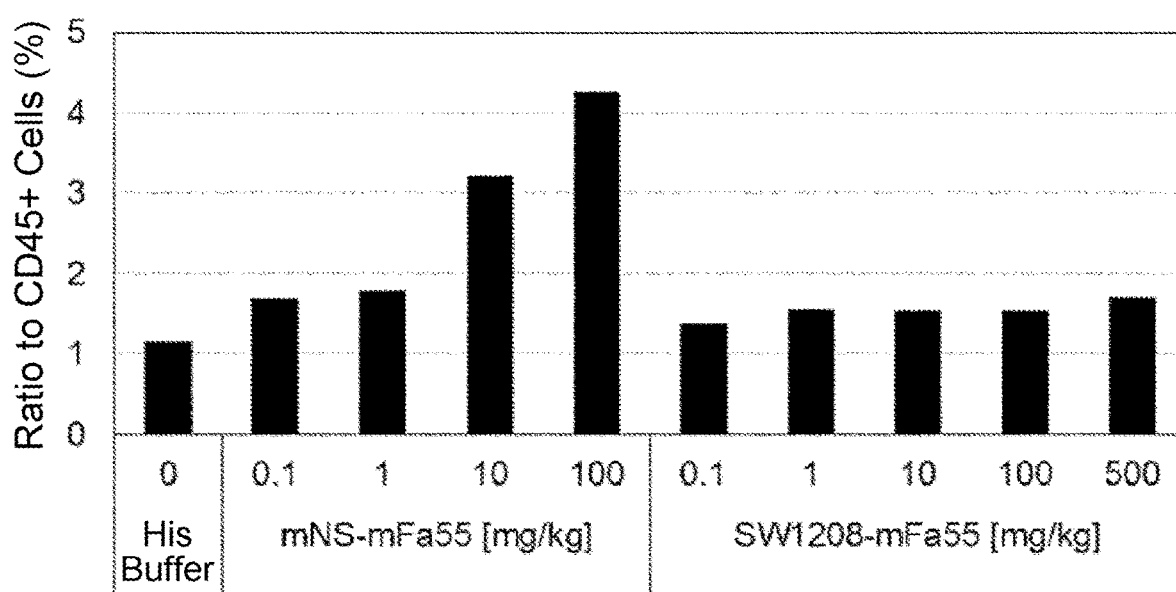
FIG. 31 shows the changes in the ratio of activated helper T cells in the spleen when the anti-CTLA-4 antibody mNS-mFa55 (control antibody) or SW1208-mFa55 (switch antibody) was administered in a mouse model transplanted with the FM3A cell line, as described in Reference Example 3-7-8. mNS-mFa55 was administered at 0.1 mg/kg, 1 mg/kg, 10 mg/kg, and 100 mg/kg via the tail vein, and SW1208-mFa55 was administered at 0.1 mg/kg, 1 mg/kg, 10 mg/kg, 100 mg/kg, and 500 mg/kg via the tail vein. The spleen was harvested six days after the administration, and the increase or decrease in activated helper T cells was evaluated by FACS analysis. The longitudinal axis is the ratio of activated helper T cells (CD4+ Foxp3-ICOS+) to CD45+ cells. The mean value of n=3 is shown.

(3-7-8) Evaluation of the Systemic Effects on the Spleen in FM3A Cell-Transplanted Model Changes in activated helper T cells (CD4$^+$ Foxp3$^-$ ICOS$^+$) in the spleen after administration of mNS-mFa55 or SW1208-mFa55 were evaluated by FACS analysis. As a result, the ratio of activated helper T cells to CD45-positive cells in the spleen increased significantly when mNS-mFa55 was administered, but there was no significant increase in the ratio of activated helper T cells to CD45-positive cells in the spleen even when the administration dose of SW1208-mFa55 was increased (FIG. 31). It was confirmed that while the switch antibody showed the same efficacy as the control antibody, it did not evoke response in tissues other than the tumor, and the concept of showing activity only locally in the tumor was proven in vivo in mouse.

Reference Example 4

Generation of Altered CTLA4 Antibodies and Evaluation of their Activities

Further alteration and evaluation of the anti-CTLA4 switch antibodies generated in Reference Example 3 were carried out.

(4-1) Enhancement of the Binding Ability to CTLA4 by Alterations of Enhancing Binding to ATP From the results of the structural analysis performed in Reference Example 2-1, it was shown that CDR2 of the antibody heavy chain interacts with the phosphate group of AMP. It was considered that when the small molecule was ATP, the γ-phosphate group might cause steric hindrance to heavy chain CDR2. Then, amino acids in this region were substituted to examine the enhancement of the binding ability to ATP. Specifically, 04H1389-G1m/04L1086-lam1 and 04H1382-G1m/04L1086-lam1 were generated by introducing the alterations of R53Q and G55H into the heavy chain variable regions of 04H1207-G1m/04L1086-lam1 and 04H1208-G1m/04L1086-lam1 generated in Reference Example 3. In addition, 04H1389-G1m/04L1305-k0MT was generated by substituting the light chain of 04H1389-G1m/04L1086-lam1 with the sequence of human κ chain. Table 30 lists SEQ ID NOs of the heavy chain variable regions, light chain variable regions, heavy chain constant regions, light chain constant regions, and hypervariable regions of these antibodies.

Amino acid sequences of heavy chains, light chains, and their hypervariable regions (indicated by SEQ ID NO:)

TABLE 30

| | Variable Region | | Constant Region | | Hyper Variable Region (HVR) | | | | | |
|---|---|---|---|---|---|---|---|---|---|---|
| Antibody name | Heavy Chain | Light Chain | Heavy Chain | Light Chain | H1 | H2 | H3 | L1 | L2 | L3 |
| 04H1389-G1m/04L1086-lam1 | 136 | 97 | 82 | 87 | 107 | 110 | 102 | 122 | 117 | 133 |
| 04H1382-G1m/04L1086-lam1 | 135 | 97 | 82 | 87 | 107 | 109 | 102 | 122 | 117 | 133 |
| 04H1389-G1m/04L1305-k0MT | 136 | 95 | 82 | 96 | 107 | 110 | 102 | 122 | 117 | 133 |

Biacore T200 was used to evaluate the binding of the generated variants to ATP and to human CTLA4. The assay of binding to ATP was performed at 37° C. using 20 mM ACES (pH 7.4), 150 mM NaCl, 2 mM MgCl$_2$, 0.05% Tween20 as the running buffer. First, Sure Protein A (GE Healthcare) was immobilized onto a Series S Sensor Chip CM3 (GE Healthcare), and the antibodies were captured onto the chip by interacting an antibody solution prepared in the running buffer. Next, the binding ability to the antibody was evaluated by interacting with an ATP solution prepared in the running buffer. Chips were regenerated with 25 mM NaOH and 10 mM Glycine-HCl (pH 1.5) and assay was performed by repeatedly capturing antibodies. For the binding amount of each antibody to ATP, the binding amount of ATP per unit amount of antibody was calculated by correcting the amount of binding when ATP was injected at a concentration of 100 nM with the amount of antibody captured onto the chip surface. Binding to human CTLA4 was measured using Biacore T200 by the method described in Reference Example 3-3. Table 31 shows the results of these measurements.

Analysis of Binding to ATP and to Human CTLA4

TABLE 31

| | | Binding to Human CTLA4 | | | | $K_D$ for Human CTLA4 (M) | | |
|---|---|---|---|---|---|---|---|---|
| Antibody name | Binding to ATP | No ATP | ATP = 1 μM | ATP = 10 μM | ATP = 100 μM | No ATP | ATP = 10 μM | ATP = 100 μM |
| 04H1207-G1m/04L1086-lam1 | 0.00013 | 0.010 | 0.037 | 0.111 | 0.166 | N.A. | 4.0E−07 | 7.6E−08 |
| 04H1208-G1m/04L1086-lam1 | 0.00018 | 0.003 | 0.022 | 0.084 | 0.139 | N.A. | 5.1E−07 | 9.1E−08 |
| 04H1389-G1m/04L1086-lam1 | 0.00243 | 0.022 | 0.138 | 0.189 | 0.193 | *5.1E−06 | 4.3E−08 | 2.1E−08 |
| 04H1382-G1m/04L1086-lam1 | 0.00204 | 0.008 | 0.090 | 0.152 | 0.159 | N.A. | 4.6E−08 | 1.4E−08 |
| 04H1389-G1m/04L1305-k0MT | 0.00190 | 0.030 | 0.120 | 0.154 | 0.151 | *3.2E−06 | 1.9E−08 | 5.4E−09 |

N.A.; Extremely weak for determining KD value
*KD value was determined by the steady state model.

04H1389-G1m/04L1086-lam1 and 04H1382-G1m/04L1086-lam1 had enhanced binding ability to ATP compared to the parent antibodies 04H1207-G1m/04L1086-lam1 and 04H1208-G1m/04L1086-lam1 for which R53Q/G55H was not introduced. The binding ability of 04H1389-G1m/04L1086-lam1 and 04H1382-G1m/04L1086-lam1 to human CTLA4 was enhanced about 10-fold in the presence of 10 μM ATP compared with the parent antibodies 04H1207-G1m/04L1086-lam1 and 04H1208-G1m/04L1086-lam1 for which R53Q/G55H was not introduced. Comparison of the binding amounts showed that the ability to bind to human CTLA4 at lower ATP concentrations was enhanced. 04H1389-G1m/04L1305-k0MT, in which the light chain of 04H1389-G1m/04L1086-lam1 was substituted with the sequence of human κ chain, was also shown to have an equivalent ATP-binding ability and ATP-dependent human CTLA4-binding ability as 04H1389-G1m/04L1086-lam1.

(4-2) Generation of Anti-Human CTLA4 Control Antibody and Anti-CTLA4 Switch Antibody, and Evaluation of their Binding Ability An anti-human CTLA4 control antibody (MDX10D1H-mFa55/MDX10D1L-mk1, abbreviation: hNS-mFa55) and an anti-CTLA4 switch antibody (04H1389-mFa55/04L1305-mk1, abbreviation: SW1389-mFa55) were generated. In the hNS-mFa55 antibody, the heavy chain variable region MDX10D1H (SEQ ID NO: 26) and the light chain variable region MDX10D1L (SEQ ID NO: 27) were used, and for the constant regions, the mouse heavy chain constant region mFa55 (SEQ ID NO: 18) and the wild type mouse light chain constant region mk1 (SEQ ID NO: 19) were used. At this time, a mouse heavy chain constant region to which alterations were added to enhance binding to the Fcγ receptor was used. The antibody was expressed and purified by a method known to those skilled in the art. In the SW1389-mFa55 antibody, the heavy chain variable region 04H1389 (SEQ ID NO: 29) and the light chain variable region 04L1305 (SEQ ID NO: 30) were used, and for the constant regions, the mouse heavy chain constant region mFa55 (SEQ ID NO: 18) and the wild type mouse light chain constant region mk1 (SEQ ID NO: 19) were used. At this time, a mouse heavy chain constant region to which alterations were added to enhance binding to the Fcγ receptor was used. The antibody was expressed and purified by a method known to those skilled in the art.

The binding of the generated hNS-mFa55 and SW1389-mFa55 to human CTLA4 was evaluated. 20 mM ACES (pH 7.4), 150 mM NaCl, 2 mM $MgCl_2$, 0.05% Tween 20 with ATP added to the desired concentrations was used as the running buffer, and the assay was performed at 37° C. First, Rabbit Anti-Mouse IgG (Thermo Fisher Scientific) was immobilized onto Series S Sensor Chips CM5 (GE Healthcare), and the antibody was captured onto the chip by interacting an antibody solution prepared in an ATP-free running buffer. Next, the binding ability of the antibody to human CTLA4 in the presence or absence of ATP was evaluated by interacting with a human CTLA4 solution prepared in a running buffer with ATP added to the desired concentration, or a human CTLA4 solution prepared in an ATP-free running buffer. Chips were regenerated with 25 mM NaOH and 10 mM Glycine-HCl (pH 1.5) and assay was performed by repeatedly capturing antibodies. The dissociation constant of each antibody for CTLA4 was calculated using Biacore T200 Evaluation Software 2.0. Specifically, the binding rate constant ka (L/mol/s) and the dissociation rate constant kd (1/s) were calculated by global fitting of the sensorgrams obtained by the measurement using the 1:1 Langmuir binding model, and the dissociation constant KD (mol/L) was calculated from those values. Table 32 shows the results of these assay.

Binding analysis of variants with mouse constant regions to human CTLA4

TABLE 32

| | $K_D$ for Human CTLA4 (M) | | |
|---|---|---|---|
| Antibody name | ATP = 1 μM | ATP = 10 μM | ATP = 100 μM |
| MDX10D1H-mFa55/MDX10D1L-mk1 | 3.2E−08 | 3.8E−08 | 3.6E−08 |
| 04H1389-mFa55/04L1305-mk1 | 5.1E−08 | 1.8E−08 | 8.9E−09 |

It was confirmed that both of the two antibodies generated using the mouse constant regions bind to human CTLA4. SW1389-mFa55 was also shown to bind to human CTLA4 in an ATP-dependent manner, similar to 04H1389-G1m/04L1305-k0MT generated using the same variable region and human constant region shown in Table 31.

(4-3) Efficacy of Each of the Anti-CTLA4 Switch Antibody and Anti-CTLA4 Non-Switch Antibody in a Syngeneic Tumor Cell-Transplanted Model Using Human CTLA4 Knock-In, Human CD3 Transgenic Mouse, Increase/Decrease of Treg Cells in Tumor, and Change in Systemic Response Marker in the Spleen (4-3-1) Cell Line Hepa1-6/hGPC3 cells were used. This cell line was obtained by purchasing mouse liver cancer line Hepa1-6 cells from ATCC, constitutively expressing the human Glypican 3 (hGPC3, SEQ ID NO: 181) gene by transfection, and performing cloning. Hepa1-6/hGPC3 cells were maintained and passaged in D-MEM (high glucose) medium (SIGMA) containing 10% FBS (SIGMA) and 600 µg/mL GENETICIN (Gibco).

(4-3-2) Preparation of a Syngeneic Tumor Line-Transplanted Mouse Model

A human CTLA4 KI, human CD3 EDG-replaced mice (hCTLA4 KI hCD3 EDG-replaced mice), which is a hybrid of a human CTLA4 knock-in mouse (Blood (2005) 106 (9): 3127-3133) and an in-house generated human CD3 EDG-replaced mouse (Sci Rep (2017) 7:45839), was used. Hepa1-6/hGPC3 cells were transplanted subcutaneously into the hCTLA4 KI hCD3 EDG-replaced mice, and the model was determined to be established when the average volume of the transplanted tumors reached from approximately 200 mm³ to approximately 400 mm³.

The volume of the transplanted tumor was calculated by the following formula.

Tumor volume=long diameter×short diameter×short diameter/2

(4-3-3) Preparation of Drugs for Administration

As the drugs to be administered to the Hepa1-6/hGPC3 cell-transplanted model, the anti-CTLA4 switch antibody (SW1389-mFa55) and the anti-human CTLA4 control antibody (hNS-mFa55) prepared in Reference Example 4-2 were prepared at the concentrations of 0.01, 0.1, 1, 5, 10, and 20 mg/mL and 0.01, 0.1, 1, and 3 mg/mL, respectively, using His buffer (150 mM NaCl/20 mM His-HCl buffer, pH 6.0).

(4-3-4) Drug Administration for Measuring the Antitumor Effect

On the 7th day after transplantation, SW1389-mFa55 was administered to mice at 0.1 mg/kg, 1 mg/kg, 10 mg/kg, and 100 mg/kg, and hNS-mFa55 was administered at 0.1 mg/kg, 1 mg/kg, 10 mg/kg, and 30 mg/kg, via the tail vein. Table 33 shows the details of the drug treatment in measuring the antitumor effect.

Measurement of the Antitumor Effect in Hepa1-6/hGPC3 Cell-Transplanted Model

TABLE 33

| Group | Heads | Drug | Dose | Administration route | Administration date |
|---|---|---|---|---|---|
| 1 | 4 | His buffer | — | Tail Vein | 7th day after transplantation |
| 2 | 4 | hNS-mFa55 | 0.1 mg/kg | Tail Vein | 7th day after transplantation |
| 3 | 4 | hNS-mFa55 | 1 mg/kg | Tail Vein | 7th day after transplantation |
| 4 | 4 | hNS-mFa55 | 10 mg/kg | Tail Vein | 7th day after transplantation |
| 5 | 4 | hNS-mFa55 | 30 mg/kg | Tail Vein | 7th day after transplantation |
| 6 | 4 | SW1389-mFa55 | 0.1 mg/kg | Tail Vein | 7th day after transplantation |
| 7 | 4 | SW1389-mFa55 | 1 mg/kg | Tail Vein | 7th day after transplantation |
| 8 | 4 | SW1389-mFa55 | 10 mg/kg | Tail Vein | 7th day after transplantation |
| 9 | 4 | SW1389-mFa55 | 100 mg/kg | Tail Vein | 7th day after transplantation |

(4-3-5) Evaluation of the Antitumor Effect

The antitumor effect was evaluated by the tumor volume calculated by the formula described in (4-3-2). JMP 11.2.1 (SAS Institute Inc.) was used for statistical analysis.

The TGI (tumor growth inhibition) value was calculated by the following formula.

TGI=(1−(Mean value of tumor volume in the group of interest at the time of measurement−Mean value of tumor volume before antibody administration)/(Mean value of tumor volume in the control group at the time of measurement−Mean value of tumor volume before antibody administration))×100

Figure 32:
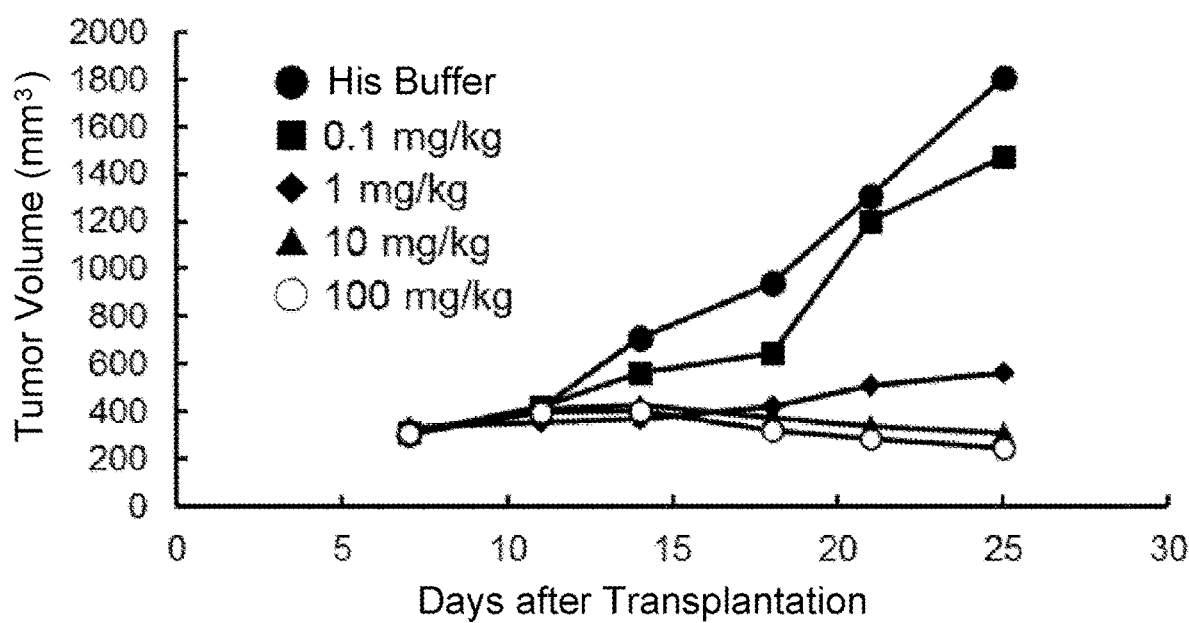
FIG. 32 shows the antitumor effect of the anti-CTLA-4 antibody SW1389-mFa55 (switch antibody) in a mouse model transplanted with the Hepa1-6/hGPC3 cell line, as described in Reference Example 4-3-5. The antibody was administered at 0.1 mg/kg, 1 mg/kg, 10 mg/kg, and 100 mg/kg via the tail vein. Each point represents the mean tumor volume of a group, n=4.
Figure 33:
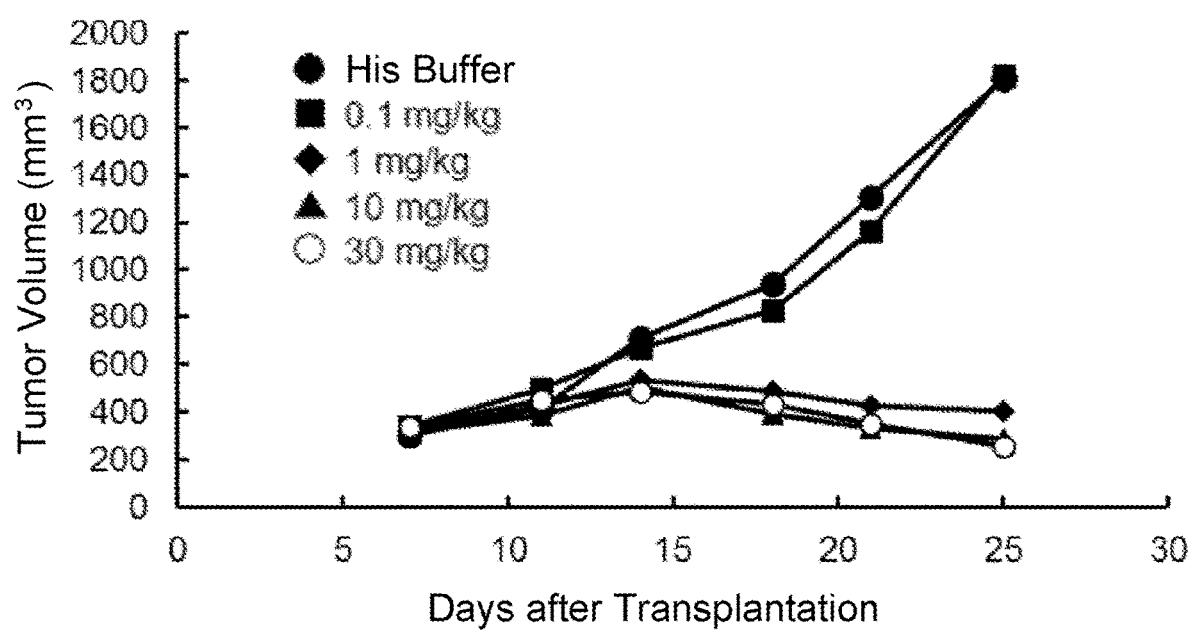
FIG. 33 shows the antitumor effect of the anti-CTLA-4 antibody hNS-mFa55 (control antibody) in a mouse model transplanted with the Hepa1-6/hGPC3 cell line, as described in Reference Example 4-3-5. The antibody was administered at 0.1 mg/kg, 1 mg/kg, 10 mg/kg, and 30 mg/kg via the tail vein. Each point represents the mean tumor volume of a group, n=4.

As a result, both hNS-mFa55 and SW1389-mFa55 showed a drug efficacy of TGI=60 or more on the 18th day after administration at doses of 1 mg/kg or more (FIGS. 32 and 33).

(4-3-6) Drug Administration for Evaluation of Treg Cells in Tumor and Verification of Systemic Effects in Spleen On the 7th day after transplantation, SW1389-mFa55 was administered to mice at 0.1 mg/kg, 1 mg/kg, 10 mg/kg, 100 mg/kg, and 500 mg/kg via the tail vein, and hNS-mFa55 was administered at 0.1 mg/kg, 1 mg/kg, 10 mg/kg, and 30 mg/kg via the tail vein. Table 34 shows details of drug treatment for evaluation of Treg cells in the tumor and verification of systemic effects in the spleen.

Verification of intratumoral and systemic effects in Hepa1-6/hGPC3 cell-transplanted model (hNS-mFa55 and SW1389-mFa55)

TABLE 34

| Group | Heads | Drug | Dose | Administration route | Administration date |
|---|---|---|---|---|---|
| 1 | 3 | His buffer | — | Tail Vein | 7th day after transplantation |
| 2 | 3 | hNS-mFa55 | 0.1 mg/kg | Tail Vein | 7th day after transplantation |
| 3 | 3 | hNS-mFa55 | 1 mg/kg | Tail Vein | 7th day after transplantation |
| 4 | 3 | hNS-mFa55 | 10 mg/kg | Tail Vein | 7th day after transplantation |

TABLE 34-continued

| Group | Heads | Drug | Dose | Administration route | Administration date |
|---|---|---|---|---|---|
| 5 | 3 | hNS-mFa55 | 30 mg/kg | Tail Vein | 7th day after transplantation |
| 6 | 3 | SW1389-mFa55 | 0.1 mg/kg | Tail Vein | 7th day after transplantation |
| 7 | 3 | SW1389-mFa55 | 1 mg/kg | Tail Vein | 7th day after transplantation |
| 8 | 3 | SW1389-mFa55 | 10 mg/kg | Tail Vein | 7th day after transplantation |
| 9 | 3 | SW1389-mFa55 | 100 mg/kg | Tail Vein | 7th day after transplantation |
| 10 | 3 | SW1389-mFa55 | 500 mg/kg | Tail Vein | 7th day after transplantation |

(4-3-7) Resection of Tumor and Spleen from Hepa1-6/hGPC3 Cell-Transplanted Model Mice On the 6th day after antibody administration, the mice were euthanized under anesthesia, and the tumors and spleens were resected. From the resected spleens, a cell suspension was prepared using RPMI-1640 medium (SIGMA) containing 10% FBS (SIGMA), and then hemolyzed using the Mouse Erythrocyte Lysing kit (R & D) to prepare spleen cells. The resected tumors were crushed using a Tumor dissociation kit, mouse (Miltenyi). Both spleen cells and crushed tumors were reacted with the following antibodies, and the fractions of immune cells present was analyzed by FACS analysis: anti-CD45 antibody (BD, clone: 30-F11), anti-CD3 antibody (BD, clone: UCHT1), anti-CD4 antibody (BD, clone: RM4-5), anti-FoxP3 antibody (eBioscience, clone: FJK-16s), anti-ICOS antibody (eBioscience, clone: 7E17G9), anti-CCR7 antibody (Biolegend, clone: 4B12), anti-KLRG1 antibody (Biolegend, clone: 2F1/KLRG1). FACS analysis was performed by BD LSR Fortessa X-20 (BD).

(4-3-8) Tumor Treg Evaluation in Hepa1-6/hGPC3 Cell-Transplanted Model

Figure 34:
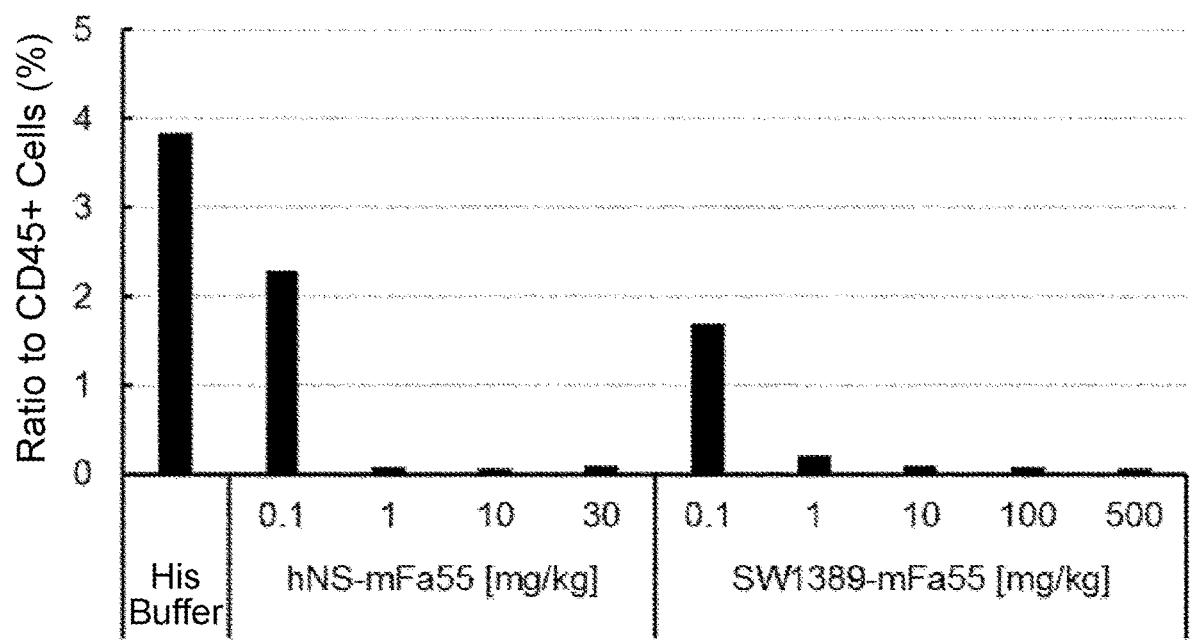
FIG. 34 shows the changes in the ratio of effector Treg cells in a tumor when the anti-CTLA-4 antibody hNS-mFa55 (control antibody) or SW1389-mFa55 (switch antibody) was administered in a mouse model transplanted with the Hepa1-6/hGPC3 cell line, as described in Reference Example 4-3-8. hNS-mFa55 was administered at 0.1 mg/kg, 1 mg/kg, 10 mg/kg, and 30 mg/kg, and SW1389-mFa55 was administered at 0.1 mg/kg, 1 mg/kg, 10 mg/kg, 100 mg/kg, and 500 mg/kg, via the tail vein. The tumor was harvested six days after the administration, and the increase or decrease in effector Treg was evaluated by FACS analysis. The longitudinal axis is the ratio of effector Treg (CD4+ FoxP3+ CCR7low KLRG1+) to CD45+ cells. The mean value of n=3 is shown.

Changes in effector Treg cells (CD4$^+$ FoxP3$^+$ CCR7$^{low}$ KLRG1$^+$) in the tumor after administration of SW1389-mFa55 or hNS-mFa55 were evaluated. As a result, both hNS-mFa55 and SW1389-mFa55 reduced the ratio of effector Treg to less than 0.2% of CD45-positive cells at doses of 1 mg/kg or more (FIG. 34).

Figure 35:
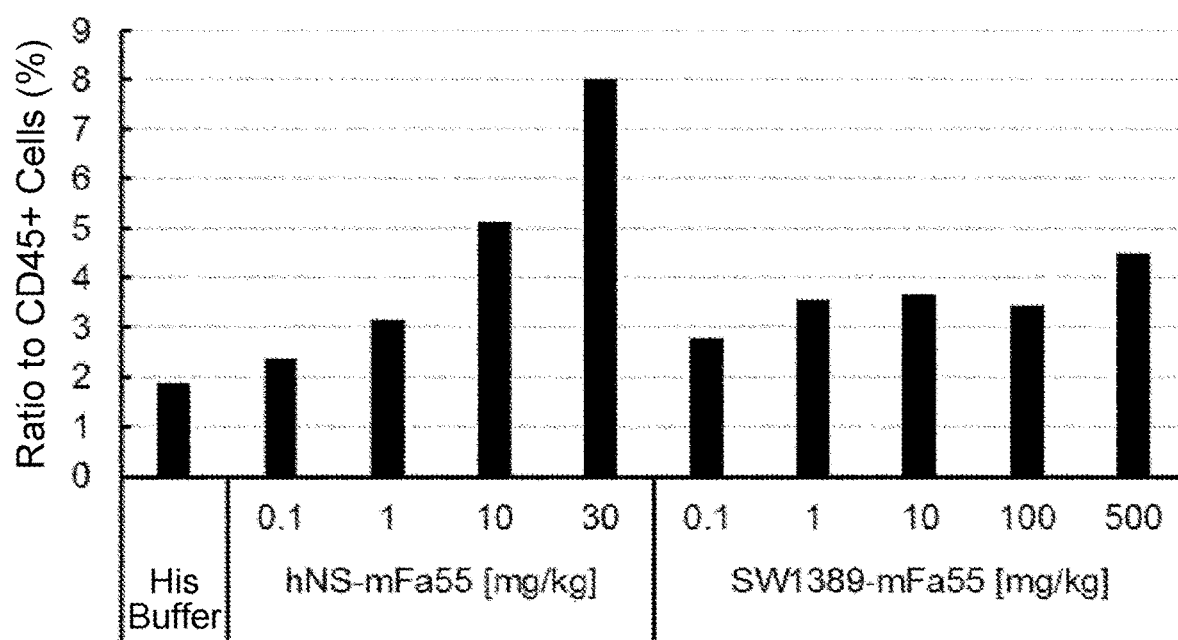
FIG. 35 shows the changes in the ratio of activated helper T cells in the spleen when the anti-CTLA-4 antibody hNS-mFa55 (control antibody) or SW1389-mFa55 (switch antibody) was administered in a mouse model transplanted with the Hepa1-6/hGPC3 cell line, as described in Reference Example 4-3-9. hNS-mFa55 was administered at 0.1 mg/kg, 1 mg/kg, 10 mg/kg, and 30 mg/kg, and SW1389-mFa55 was administered at 0.1 mg/kg, 1 mg/kg, 10 mg/kg, 100 mg/kg, and 500 mg/kg, via the tail vein. The spleen was harvested six days after the administration, and the increase or decrease in activated helper T cells was evaluated by FACS analysis. The longitudinal axis is the ratio of activated helper T cells (CD4+ Foxp3-ICOS+) to CD45+ cells. The mean value of n=3 is shown.

(4-3-9) Evaluation of the Systemic Effect in the Spleen in the Hepa1-6/hGPC3 Cell-Transplanted Model Changes in activated helper T cells (CD4$^+$ Foxp3$^-$ ICOS$^+$) in the spleen after administration of hNS-mFa55 or SW1389-mFa55 were evaluated by FACS analysis. As a result, the ratio of activated helper T cells to CD45-positive cells in the spleen increased significantly when hNS-mFa55 was administered, but no significant increase of activated helper T cells in the spleen was observed when SW1389-mFa55 was administered, even when the administration dose was increased (FIG. 35). This confirmed that the switch antibody showed the same efficacy as the control antibody, but did not evoke response in tissues other than the tumor. Thus, the concept of showing activity only locally in the tumor was proven in vivo in human CTLA4 KI mice.

Reference Example 5

Generation of Altered CTLA4 Antibodies and Evaluation of their Activities

Further alteration and evaluation of the anti-CTLA4 switch antibodies prepared in Reference Example 4 were carried out.

(5-1) Antibody Optimization by Introduction of Comprehensive Alterations and Substitution of Frameworks Amino acid alterations were comprehensively introduced into the CDRs of 04H1389-G1m/04L1086-lam1, and alterations with better profiles were explored. Comprehensive introduction and evaluation of amino acid alterations were performed using the method described in Reference Example 3-3. Variants in which a combination of alterations discovered herein was introduced and the Frameworks were substituted were generated. Table 35 lists the SEQ ID NOs of the heavy chain variable regions, light chain variable regions, heavy chain constant regions, light chain constant regions, and hypervariable regions of these antibodies. Light chains 04L1594-lam1, 04L1581-lam1, 04L1610-lam1, 04L1612-lam1, and 04L1610-lam1 in Table 35 were introduced with alterations in the CDRs and frameworks compared to the parent antibody light chain 04L1086-lam1, and have the frameworks and constant region of the germline sequences of the human λ chain. In addition, 04L1615-k0MT, 04L1616-k0MT, and 04L1617-k0MT have alterations introduced into CDRs of 04L1086-lam1 and have the frameworks and constant region of the germline sequences of the human κ chain. The heavy chain variable region 04H1389v373 is one introduced with alterations in the CDRs of the heavy chain variable region 04H1389 of the parent antibody. The heavy chain variable regions 04H1637, 04H1643, 04H1654, 04H1656, 04H1642, and 04H1735 have alterations introduced into the CDRs of 04H1389, as well as substitutions of the framework sequences with those of a different germline.

Amino acid sequences of heavy chains, light chains, and their hypervariable regions (indicated by SEQ ID NOs:)

TABLE 35

| | Variable Region | | Constant Region | | Hyper Variable Region (HVR) | | | | | |
|---|---|---|---|---|---|---|---|---|---|---|
| Antibody name | Heavy Chain | Light Chain | Heavy Chain | Light Chain | H1 | H2 | H3 | L1 | L2 | L3 |
| 04H1389v373-G1m/04L1086-lam1 | 137 | 97 | 82 | 87 | 107 | 111 | 102 | 122 | 117 | 133 |
| 04H1637-G1m/04L1086-lam1 | 138 | 97 | 82 | 87 | 107 | 111 | 102 | 122 | 117 | 133 |
| 04H1637-G1m/04L1594-lam1 | 138 | 144 | 82 | 87 | 107 | 111 | 102 | 124 | 125 | 133 |
| 04H1637-G1m/04L1581-lam1 | 138 | 145 | 82 | 87 | 107 | 111 | 102 | 126 | 127 | 133 |
| 04H1637-G1m/04L1610-lam1 | 138 | 146 | 82 | 87 | 107 | 111 | 102 | 128 | 117 | 133 |
| 04H1643-G1m/04L1610-lam1 | 139 | 146 | 82 | 87 | 107 | 111 | 102 | 128 | 117 | 133 |

TABLE 35-continued

| Antibody name | Variable Region | | Constant Region | | Hyper Variable Region (HVR) | | | | | |
|---|---|---|---|---|---|---|---|---|---|---|
| | Heavy Chain | Light Chain | Heavy Chain | Light Chain | H1 | H2 | H3 | L1 | L2 | L3 |
| 04H1654-G1m/04L1610-lam1 | 140 | 146 | 82 | 87 | 107 | 112 | 102 | 128 | 117 | 133 |
| 04H1656-G1m/04L1610-lam1 | 141 | 146 | 82 | 87 | 107 | 111 | 152 | 128 | 117 | 133 |
| 04H1654-G1m/04L1612-lam1 | 140 | 147 | 82 | 87 | 107 | 112 | 102 | 129 | 117 | 133 |
| 04H1656-G1m/04L1612-lam1 | 141 | 147 | 82 | 87 | 107 | 111 | 152 | 129 | 117 | 133 |
| 04H1654-G1m/04L1606-lam1 | 140 | 148 | 82 | 87 | 107 | 112 | 102 | 124 | 117 | 133 |
| 04H1656-G1m/04L1606-lam1 | 141 | 148 | 82 | 87 | 107 | 111 | 152 | 124 | 117 | 133 |
| 04H1389-G1m/04L1615-k0MT | 136 | 149 | 82 | 96 | 107 | 110 | 102 | 130 | 117 | 133 |

The binding activity of the generated variants to human CTLA4 was evaluated by the method described in Reference Example 3-3 (Table 36).

Analysis of the Binding to Human CTLA4

TABLE 36

| Antibody name | $K_D$ for Human CTLA4 (M) | | |
|---|---|---|---|
| | No ATP | ATP = 1 µM | ATP = 10 µM |
| MDX10D1H-G1m/MDX10D1L-k0MT | 4.8E−08 | 5.0E−08 | 4.9E−08 |
| 04H1389-G1m/04L1086-lam1 | *5.7E−06 | 1.8E−07 | 3.7E−08 |
| 04H1389v373-G1m/04L1086-lam1 | *5.3E−06 | 1.4E−07 | 2.8E−08 |
| 04H1637-G1m/04L1086-lam1 | *5.3E−06 | 1.6E−07 | 3.0E−08 |
| 04H1637-G1m/04L1594-lam1 | *4.3E−06 | 1.4E−07 | 2.8E−08 |
| 04H1637-G1m/04L1581-lam1 | *3.2E−06 | 8.9E−08 | 1.7E−08 |
| 04H1637-G1m/04L1610-lam1 | *3.3E−06 | 1.0E−07 | 1.8E−08 |
| 04H1643-G1m/04L1610-lam1 | *2.8E−06 | 8.9E−08 | 1.4E−08 |
| 04H1654-G1m/04L1610-lam1 | 5.3E−06 | 1.2E−07 | 1.9E−08 |
| 04H1656-G1m/04L1610-lam1 | *2.2E−06 | 9.8E−08 | 1.9E−08 |
| 04H1654-G1m/04L1612-lam1 | *4.8E−06 | 2.0E−07 | 3.3E−08 |
| 04H1656-G1m/04L1612-lam1 | *7.6E−06 | 1.6E−07 | 3.2E−08 |
| 04H1654-G1m/04L1606-lam1 | *6.8E−06 | 1.4E−07 | 2.5E−08 |
| 04H1656-G1m/04L1606-lam1 | *2.3E−06 | 9.5E−08 | 1.9E−08 |
| 04H1389-G1m/04L1305-k0MT | *2.4E−06 | 8.2E−08 | 1.5E−08 |
| 04H1389-G1m/04L1615-k0MT | *2.0E−06 | 7.2E−08 | 1.5E−08 |

*KD value was determined by the steady state model.

The KD values in the table marked with an * were calculated using the steady state model. All variants prepared using 04H1389-G1m/04L1086-lam1 as the parent antibody were shown to bind to human CTLA4 in an ATP-dependent manner and have binding ability stronger than the parent antibody with a KD of $3.7 \times 10^{-8}$ M under the condition when ATP is present at 10 µM. It was also shown that all of these antibodies have binding ability stronger than the existing anti-human CTLA4 antibody MDX10D1H-G1m/MDX10D1L-k0MT under the condition when ATP is present at 10 µM.

The binding ability of the generated variants to human CTLA4 in the presence of ADP or AMP was evaluated by Biacore T200 and compared with the binding ability in the presence of ATP. The binding ability to human CTLA4 in the presence of ADP or AMP was measured using the method described in Reference Example 3-3, as in the evaluation of the binding ability in the presence of ATP, but using ADP or AMP instead of ATP (Table 37).

Assessment of ATP, ADP and AMP Dependency

TABLE 37

| | Kinetic parameters for human CTLA4 | | | | | | | | |
| --- | --- | --- | --- | --- | --- | --- | --- | --- | --- |
| | ATP = 10 μM | | | ADP = 10 μM | | | AMP = 10 μM | | |
| Antibody name | ka ($M^{-1} s^{-1}$) | kd ($s^{-1}$) | $K_D$ (M) | ka ($M^{-1} s^{-1}$) | kd ($s^{-1}$) | $K_D$ (M) | ka ($M^{-1} s^{-1}$) | kd ($s^{-1}$) | $K_D$ (M) |
| MDX10D1H-G1m/MDX10D1L-k0MT | 2.9E+05 | 1.3E−02 | 4.6E−08 | 3.6E+05 | 1.3E−02 | 3.6E−08 | 3.4E+05 | 1.3E−02 | 3.9E−08 |
| 04H1389-G1m/04L1086-lam1 | 1.0E+05 | 3.2E−03 | 3.2E−08 | 1.4E+05 | 6.1E−03 | 4.4E−08 | 1.4E+05 | 1.8E−02 | 1.3E−07 |
| 04H1637-G1m/04L1610-lam1 | 1.2E+05 | 1.9E−03 | 1.5E−08 | 1.6E+05 | 3.5E−03 | 2.2E−08 | 1.5E+05 | 1.0E−02 | 7.0E−08 |
| 04H1654-G1m/04L1610-lam1 | 7.1E+04 | 1.4E−03 | 1.9E−08 | 8.8E+04 | 2.8E−03 | 3.2E−08 | 8.9E+04 | 8.9E−03 | 1.0E−07 |
| 04H1656-G1m/04L1610-lam1 | 1.3E+05 | 1.9E−03 | 1.5E−08 | 1.7E+05 | 4.3E−03 | 2.5E−08 | 1.7E+05 | 1.4E−02 | 8.2E−08 |
| 04H1654-G1m/04L1612-lam1 | 7.4E+04 | 2.7E−03 | 3.6E−08 | 8.9E+04 | 5.0E−03 | 5.6E−08 | 9.4E+04 | 1.6E−02 | 1.7E−07 |
| 04H1656-G1m/04L1612-lam1 | 1.1E+05 | 2.9E−03 | 2.6E−08 | 1.5E+05 | 6.4E−03 | 4.2E−08 | 1.5E+05 | 2.0E−02 | 1.3E−07 |
| 04H1654-G1m/04L1606-lam1 | 6.5E+04 | 1.3E−03 | 2.1E−08 | 8.0E+04 | 2.8E−03 | 3.5E−08 | 8.1E+04 | 9.0E−03 | 1.1E−07 |
| 04H1656-G1m/04L1606-lam1 | 1.2E+05 | 2.2E−03 | 1.9E−08 | 1.6E+05 | 4.8E−03 | 3.0E−08 | 1.6E+05 | 1.6E−02 | 1.0E−07 |
| 04H1389-G1m/04L1305-k0MT | 1.1E+05 | 1.9E−03 | 1.7E−08 | 1.6E+05 | 3.8E−03 | 2.5E−08 | 1.5E+05 | 1.2E−02 | 7.9E−08 |
| 04H1389-G1m/04L1615-k0MT | 1.3E+05 | 1.5E−03 | 1.1E−08 | 1.8E+05 | 3.0E−03 | 1.7E−08 | 1.7E+05 | 9.7E−03 | 5.5E−08 |

The existing human CTLA4 antibody MDX10D1H-G1m/MDX10D1L-k0MT showed similar kinetic parameters regardless of the type and presence of small molecules, whereas all ATP-dependent anti-CTLA4 antibodies bound to human CTLA4 not only in the presence of ATP but also in the presence of ADP or AMP, and the binding ability in the presence of these small molecules was higher than the binding ability in the absence of the small molecules shown in Table 36. Therefore, it was shown that these antibodies are antibodies which bind to CTLA4 in an ATP-, ADP-, and AMP-dependent manner. These antibodies had the highest binding ability in the presence of ATP, followed by the highest binding ability in the presence of ADP, and the lowest binding ability in the presence of AMP. In all cases, the binding ability in the presence of ADP was about 3 times stronger than the binding ability in the presence of AMP, and the binding ability in the presence of ATP was about 5 times stronger than the binding ability in the presence of AMP. The ka value was similar in the presence of any of the small molecules, but there was a difference in the kd value. As the dissociation in the presence of ADP was faster than in the presence of ATP, and further dissociation in the presence of AMP was faster than in the presence of ADP, it was shown that the difference in KD value depending on the type of small molecule was due to the difference in dissociation rate.

Next, the binding ability of some variants to mouse CTLA4 and cynomolgus monkey CTLA4 was evaluated. The binding activity to human CTLA4, mouse CTLA4, and cynomolgus monkey CTLA4 was evaluated using Biacore T200 by the method described in Reference Example 3-3 (Table 38). Cynomolgus monkey CTLA4 was prepared by the following method.

The gene of CyCTLA4-His-BAP (SEQ ID NO: 50), which is a fusion of His-tag and BAP-tag at the C-terminus of the extracellular region of cynomolgus monkey CTLA4, was synthesized and inserted into an animal expression plasmid. The prepared plasmid was introduced by the lipofection method into the human embryonic kidney cell-derived FreeStyle 293-F line (Invitrogen), which had been seeded in a flask following suspension in the FreeStyle 293 Expression Medium (Invitrogen) at a cell density of 1.33× $10^6$ cells/mL. Three hours after the transfection of the plasmid, biotin was added to a final concentration of 100 μM, the cells were cultured in a $CO_2$ incubator (37° C., 8% $CO_2$, 125 rpm) for 4 days, and the antigen was purified by a method known to those skilled in the art from the culture supernatant of each sample. The absorbance of the purified antigen solutions at 280 nm was measured using a spectrophotometer. From the obtained measured values, the concentration of the purified antigen was calculated using the extinction coefficient calculated by the PACE method (Protein Science (1995) 4, 2411-2423).

Analysis of the Binding to Human, Mouse, and Cynomolgus Monkey CTLA4

TABLE 38

| | $K_D$ for Human CTLA4 (M) | | | $K_D$ for Mouse CTLA4 (M) | | | $K_D$ for Monkey CTLA4 (M) | | |
| --- | --- | --- | --- | --- | --- | --- | --- | --- | --- |
| Antibody name | ATP = 1 μM | ATP = 10 μM | ATP = 100 μM | ATP = 1 μM | ATP = 10 μM | ATP = 100 μM | ATP = 1 μM | ATP = 10 μM | ATP = 100 μM |
| MDX10D1H-G1m/MDX10D1L-k0MT | 4.7E−08 | 5.3E−08 | 5.4E−08 | N.T. | N.T. | N.T. | 1.6E−07 | 1.2E−07 | 1.2E−07 |
| 04H1389-G1m/04L1305-k0MT | 7.2E−08 | 1.4E−08 | 4.6E−09 | 2.1E−07 | 3.2E−08 | 1.2E−08 | 1.4E−07 | 2.6E−08 | 1.2E−08 |
| 04H1654-G1m/04L1610-lam1 | 1.1E−07 | 1.5E−08 | 4.4E−09 | 1.8E−07 | 2.7E−08 | 1.0E−08 | 1.8E−07 | 2.8E−08 | 8.1E−09 |
| 04H1656-G1m/04L1610-lam1 | 7.9E−08 | 1.6E−08 | 6.2E−09 | 2.3E−07 | 3.7E−08 | 1.4E−08 | 1.2E−07 | 2.6E−08 | 1.0E−08 |
| 04H1654-G1m/04L1612-lam1 | 1.7E−07 | 3.0E−08 | 1.1E−08 | 3.9E−07 | 4.8E−08 | 1.8E−08 | 3.1E−07 | 5.4E−08 | 2.1E−08 |
| 04H1656-G1m/04L1612-lam1 | 9.5E−08 | 2.5E−08 | 7.8E−09 | 3.2E−07 | 5.4E−08 | 2.1E−08 | 1.6E−07 | 4.1E−08 | 1.6E−08 |
| 04H1389-G1m/04L1615-k0MT | 5.8E−08 | 1.2E−08 | 5.0E−09 | 1.6E−07 | 2.6E−08 | 1.0E−08 | 1.1E−07 | 2.1E−08 | 9.3E−09 |

N.T.; Not Tested

It was shown that all of the six small molecule-dependent CTLA4 antibodies evaluated bound not only to human CTLA4, but also to mouse CTLA4 and to cynomolgus monkey CTLA4 in an ATP-dependent manner.

(5-2) Generation of Altered Anti-CTLA4 Switch Antibodies and a Negative Control Antibody Altered anti-CTLA4 switch antibodies (04H1654-mFa55m2P1/04L1610-ml0r//04H1656-mFa55m2N1/04L1610-ml0r, abbreviation: SW1610-mFa55; 04H1654-mFa55m2P1/04L1612-ml0r//04H1656-mFa55m2N1/04L1612-ml0r, abbreviation: SW1612-mFa55; and 04H1389-mFa55/04L1615-mk1, abbreviation: SW1615-mFa55), and a negative control antibody (IC17Hdk-mFa55/IC17L-mk1, abbreviation: KLH-mFa55) were generated.

In the SW1615-mFa55 antibody, the heavy chain variable region 04H1389 (SEQ ID NO: 29) and the light chain variable region 04L1615 (SEQ ID NO: 34) were used, and for the constant regions, the mouse heavy chain constant region mFa55 (SEQ ID NO: 18) and the wild type mouse light chain constant region mk1 (SEQ ID NO: 19) were used. At this time, a mouse heavy chain constant region to which alterations were added to enhance binding to the Fcγ receptor was used. The antibody was expressed and purified by a method known to those skilled in the art.

In the SW1610-mFa55 antibody, as the constant regions, one heavy chain variable region 04H1654 (SEQ ID NO: 35) was linked to the mouse heavy chain constant region mFa55m2P1 (SEQ ID NO: 36), the other heavy chain variable region 04H1656 (SEQ ID NO: 37) was linked to the mouse heavy chain constant region mFa55m2N1 (SEQ ID NO: 38), and for the light chain variable region 04L1610 (SEQ ID NO: 39), the wild type mouse light chain constant region ml0r (SEQ ID NO: 22) was used. The antibody was expressed and purified by a method known to those skilled in the art.

In the SW1612-mFa55 antibody, as the constant regions, one heavy chain variable region 04H1654 (SEQ ID NO: 35) was linked to the mouse heavy chain constant region mFa55m2P1 (SEQ ID NO: 36), the other heavy chain variable region 04H1656 (SEQ ID NO: 37) was linked to the mouse heavy chain constant region mFa55m2N1 (SEQ ID NO: 38), and for the light chain variable region 04L1612 (SEQ ID NO: 40), the wild type mouse light chain constant region ml0r (SEQ ID NO: 22) was used. The antibody was expressed and purified by a method known to those skilled in the art.

In the negative control antibody, as the constant regions, the heavy chain variable region IC17Hdk (SEQ ID NO: 51) was linked to the mouse heavy chain constant region mFa55 (SEQ ID NO: 18), and for the light chain variable region IC17L (SEQ ID NO: 52), the wild type mouse light chain constant region mk1 (SEQ ID NO: 19) was used. The antibody was expressed and purified by a method known to those skilled in the art.

(5-3) Evaluation of the Binding Ability of Antibodies Having a Mouse Constant Region to Human CTLA4

The ability of anti-CTLA4 antibodies having a mouse constant region to bind to an antigen was evaluated by the method described in Reference Example 4-2 (Table 39). All of these antibodies having a mouse constant region were shown to have the same ATP-dependent binding ability to human CTLA4 as the antibodies shown in Table 38 having the same variable region but having a human constant region.

Binding analysis of variants with mouse constant regions to human CTLA4

TABLE 39

| Antibody name | $K_D$ for Human CTLA4 (M) | | |
|---|---|---|---|
| | ATP = 1 μM | ATP = 10 μM | ATP = 100 μM |
| MDX10D1H-mFa55/MDX10D1L-mk1 | 3.2E−08 | 3.8E−08 | 3.6E−08 |
| 04H1654-mFa55m2P1/04L1610-ml0r | 5.8E−08 | 1.7E−08 | 8.5E−09 |
| 04H1656-mFa55m2N1/04L1610-ml0r | 4.7E−08 | 1.3E−08 | 7.4E−09 |
| 04H1654-mFa55m2P1/04L1612-ml0r | 9.4E−08 | 2.9E−08 | 1.2E−08 |
| 04H1656-mFa55m2N1/04L1612-ml0r | 6.7E−08 | 2.0E−08 | 1.0E−08 |
| 04H1389-mFa55/04L1615-mk1 | 4.5E−08 | 1.5E−08 | 8.7E−09 |

(5-4) Efficacy of Anti-CTLA4 Switch Antibodies in Syngeneic Tumor Cell-Transplanted Model Using Human CTLA4 Knock-In, Human CD3 Transgenic Mouse, Increase/Decrease of Treg Cells in Tumor, and the Change of Systemic Response Marker in Spleen (5-4-1) Cell Line Hepa1-6/hGPC3 cells were used. This cell line was obtained by purchasing mouse liver cancer line Hepa1-6 cells from ATCC, constitutively expressing the human Glypican 3 (hGPC3) gene by transfection, and performing cloning. Hepa1-6/hGPC3 cells were maintained and passaged in D-MEM (high glucose) medium (SIGMA) containing 10% FBS (Sigma) and 0.6 mg/mL G418 (Nacalai Tesque).

(5-4-2) Generation of Syngeneic Tumor Line-Transplanted Mouse Model

Human CTLA4 KI, human CD3 EDG-replaced mice (hCTLA4 KI hCD3 EDG-replaced mice), which is a hybrid of a human CTLA4 knock-in mouse (Blood (2005) 106 (9): 3127-3133) and an in-house generated human CD3 EDG-replaced mouse (Sci Rep (2017) 7:45839), were used. Hepa1-6/hGPC3 cells were transplanted subcutaneously into the hCTLA4 KI hCD3 EDG-replaced mice, and the model was determined to be established when the mean volume of the transplanted tumors reached from approximately 200 mm³ to approximately 400 mm³.

The volume of the transplanted tumor was calculated by the following formula.

Tumor volume=long diameter×short diameter×short diameter/2

(5-4-3) Preparation of Drugs for Administration

The drugs to be administered to the Hepa1-6/hGPC3 cell-transplanted model were anti-CTLA4 switch antibodies (SW1610-mFa55, SW1612-mFa55, SW1615-mFa55) prepared in Reference Example 5-2. The drugs for administration were prepared using the His-buffer (20 mM His-HCl, 150 mM NaCl, pH 6.0) so as to be 0.03 mg/mL, 0.1 mg/mL, and 0.3 mg/mL.

(5-4-4) Drug Administration for Measuring the Antitumor Effect

On the 8th day after transplantation, three samples of the anti-CTLA4 switch antibodies were administered to mice at 0.3 mg/kg, 1 mg/kg, and 3 mg/kg, respectively, via the tail vein. Table 40 shows the details of the drug treatment in measuring the antitumor effect.

Measurement of the antitumor effect in Hepa1-6/hGPC3 cell-transplanted model (anti-CTLA4 switch antibodies)

TABLE 40

| Group | Heads | Drug | Dose | Administration route | Administration date |
|---|---|---|---|---|---|
| 1 | 5 | His-buffer | — | Tail Vein | 8th day after transplantation |
| 2 | 5 | SW1610-mFa55 | 0.3 mg/kg | Tail Vein | 8th day after transplantation |
| 3 | 5 | SW1610-mFa55 | 1 mg/kg | Tail Vein | 8th day after transplantation |
| 4 | 5 | SW1610-mFa55 | 3 mg/kg | Tail Vein | 8th day after transplantation |
| 5 | 5 | SW1612-mFa55 | 0.3 mg/kg | Tail Vein | 8th day after transplantation |
| 6 | 5 | SW1612-mFa55 | 1 mg/kg | Tail Vein | 8th day after transplantation |
| 7 | 5 | SW1612-mFa55 | 3 mg/kg | Tail Vein | 8th day after transplantation |
| 8 | 5 | SW1615-mFa55 | 0.3 mg/kg | Tail Vein | 8th day after transplantation |
| 9 | 5 | SW1615-mFa55 | 1 mg/kg | Tail Vein | 8th day after transplantation |
| 10 | 5 | SW1615-mFa55 | 3 mg/kg | Tail Vein | 8th day after transplantation |

(5-4-5) Evaluation of the Antitumor Effect

The antitumor effect was evaluated by the tumor volume calculated by the formula described in (5-4-2).

The tumor growth inhibition rate (TGI: Tumor Growth Inhibition) value was calculated from the following formula.

TGI (%)=(1−(Mean value of tumor volume in the group of interest at the time of measurement−Mean value of tumor volume in the group of interest at the time of initial administration)/(Mean value of tumor volume in the control group at the time of measurement−Mean value of tumor volume in the control group at the time of initial administration))×100

Figure 36:
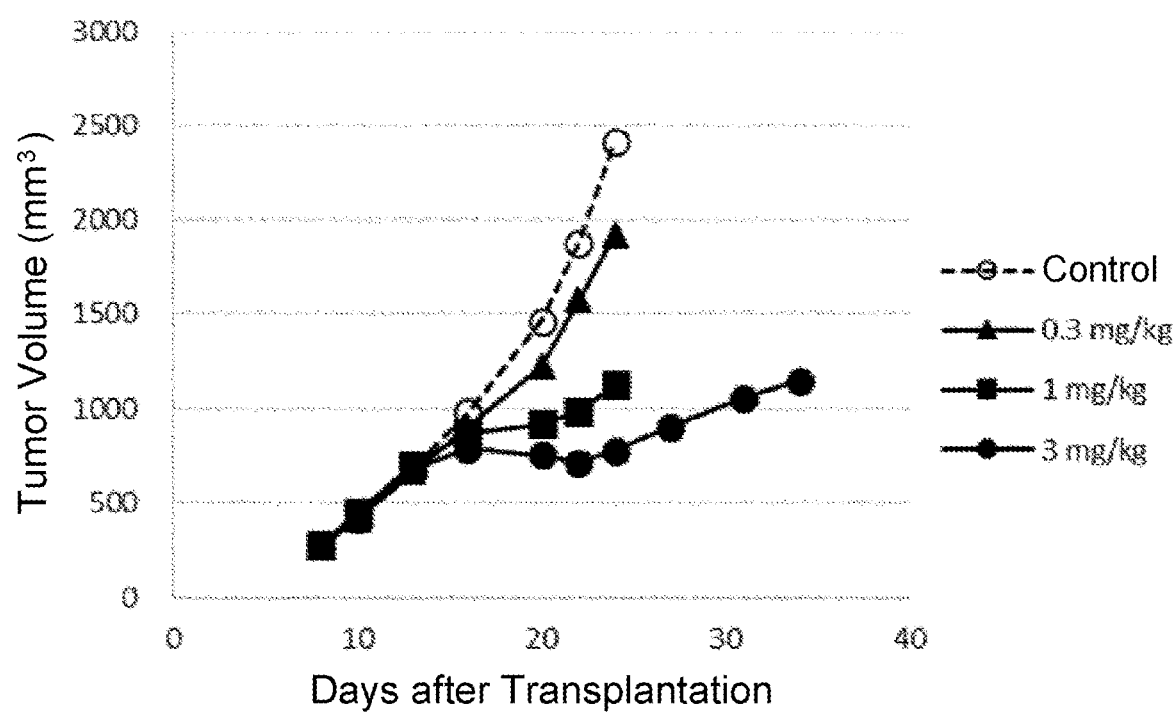
FIG. 36 shows the antitumor effect of the anti-CTLA-4 antibody SW1610-mFa55 (switch antibody) in a mouse model transplanted with the Hepa1-6/hGPC3 cell line, as described in Reference Example 5-4-5. The antibody was administered at 0.3 mg/kg, 1 mg/kg, and 3 mg/kg via the tail vein. Each point represents the mean tumor volume of a group, n=5.
Figure 37:
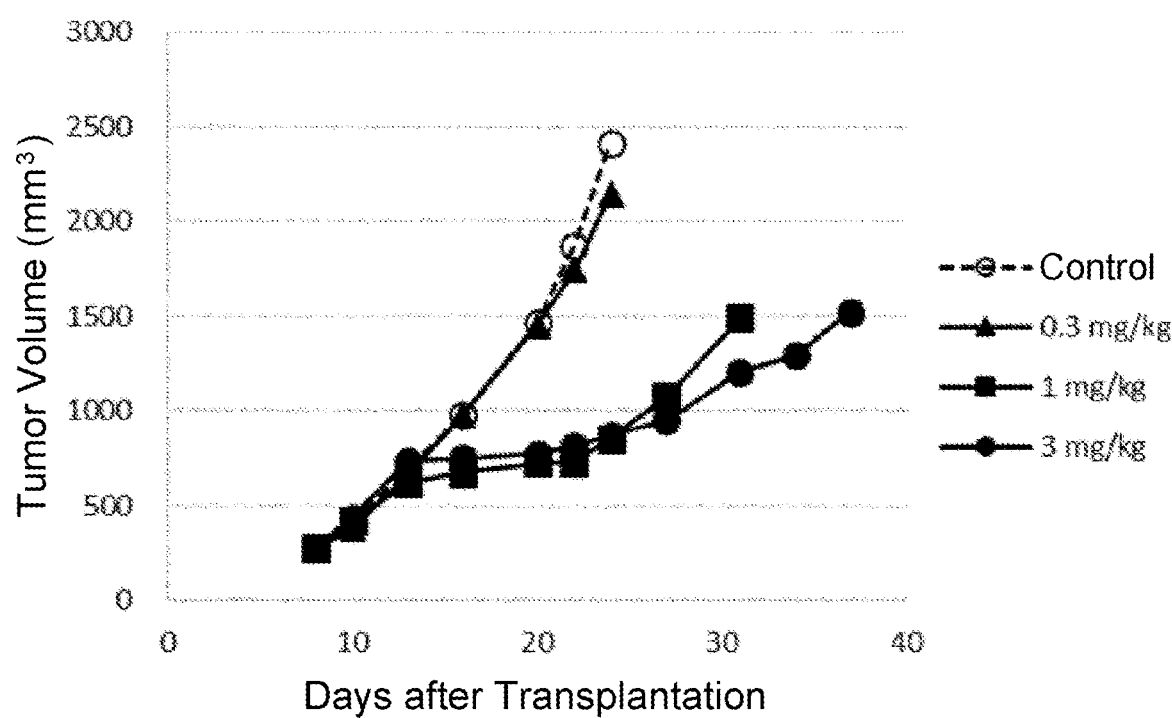
FIG. 37 shows the antitumor effect of the anti-CTLA-4 antibody SW1612-mFa55 (switch antibody) in a mouse model transplanted with the Hepa1-6/hGPC3 cell line, as described in Reference Example 5-4-5. The antibody was administered at 0.3 mg/kg, 1 mg/kg, and 3 mg/kg via the tail vein. Each point represents the mean tumor volume of a group, n=5.
Figure 38:
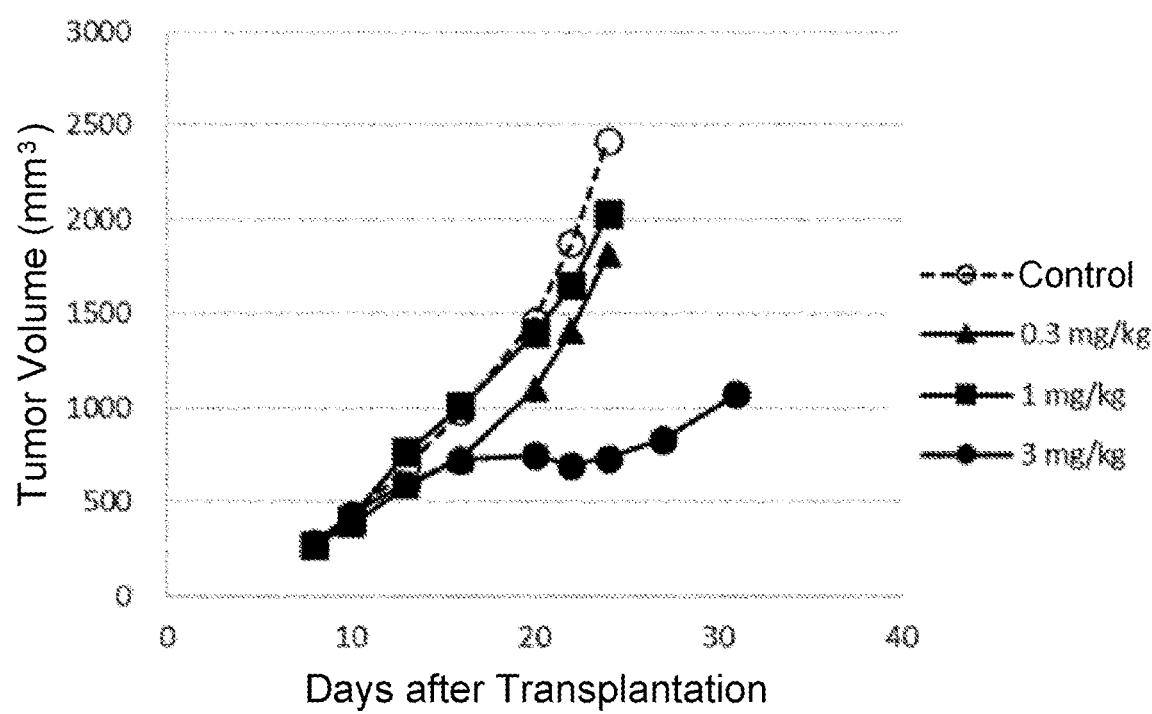
FIG. 38 shows the antitumor effect of the anti-CTLA-4 antibody SW1615-mFa55 (switch antibody) in a mouse model transplanted with the Hepa1-6/hGPC3 cell line, as described in Reference Example 5-4-5. The antibody was administered at 0.3 mg/kg, 1 mg/kg, and 3 mg/kg via the tail vein. Each point represents the mean tumor volume of a group, n=5.

As a result, SW1610-mFa55 and SW1612-mFa55 showed a drug efficacy of TGI=60% or more on the 16 day after administration at doses of 1 mg/kg or more and SW1615-mFa55 at doses of 3 mg/kg or more (FIGS. 36 to 38).

(5-4-6) Drug Administration for Evaluation of Treg Cells in Tumor and Verification of the Systemic Effect in Spleen On the 10th day after transplantation, SW1610-mFa55 was administered at 50 mg/kg, 100 mg/kg, and 200 mg/kg, SW1612-mFa55 was administered at 50 mg/kg, 100 mg/kg, and 200 mg/kg, and SW1615-mFa55 was administered at 50 mg/kg, 100 mg/kg, 200 mg/kg, and 400 mg/kg, to mice via the tail vein. In addition, for the control group, the negative control antibody IC17Hdk-mFa55/IC17L-mk1 (abbreviation: KLH-mFa55) was administered at 400 mg/kg via the tail vein. Table 41 shows details of drug treatment for evaluation of Treg cells in tumor and verification of the systemic effects in the spleen.

Verification of intratumoral and systemic effects in the Hepa1-6/hGPC3 cell-transplanted model (anti-CTLA4 switch antibodies)

TABLE 41

| Group | Heads | Drug | Dose | Administration route | Administration date |
|---|---|---|---|---|---|
| 1 | 3 | KLH-mFa55 | 400 mg/kg | Tail Vein | 10th day after transplantation |
| 2 | 3 | SW1610-mFa55 | 50 mg/kg | Tail Vein | 10th day after transplantation |
| 3 | 3 | SW1610-mFa55 | 100 mg/kg | Tail Vein | 10th day after transplantation |
| 4 | 3 | SW1610-mFa55 | 200 mg/kg | Tail Vein | 10th day after transplantation |
| 5 | 3 | SW1612-mFa55 | 50 mg/kg | Tail Vein | 10th day after transplantation |
| 6 | 3 | SW1612-mFa55 | 100 mg/kg | Tail Vein | 10th day after transplantation |
| 7 | 3 | SW1612-mFa55 | 200 mg/kg | Tail Vein | 10th day after transplantation |
| 8 | 3 | SW1615-mFa55 | 50 mg/kg | Tail Vein | 10th day after transplantation |
| 9 | 3 | SW1615-mFa55 | 100 mg/kg | Tail Vein | 10th day after transplantation |
| 10 | 3 | SW1615-mFa55 | 200 mg/kg | Tail Vein | 10th day after transplantation |
| 11 | 3 | SW1615-mFa55 | 400 mg/kg | Tail Vein | 10th day after transplantation |

(5-4-7) Resection of Tumors and Spleens from Hepa1-6/hGPC3 Cell-Transplanted Model Mice On the 6th day after the antibody administration, the mice were euthanized under anesthesia, and the tumors and spleens were resected. From the resected spleens, a cell suspension was prepared using RPMI-1640 medium (SIGMA) containing 10% FBS (SIGMA), and then hemolyzed using the Mouse Erythrocyte Lysing kit (R & D) to prepare spleen cells. The resected tumors were crushed using a Tumor dissociation kit, mouse (Miltenyi). Both spleen cells and crushed tumors were reacted with the following antibodies, and the fractions of immune cells present was analyzed by FACS analysis: anti-CD45 antibody (BD, clone: 30-F11), anti-CD3 antibody (BD, clone: UCHT1), anti-CD4 antibody (BD, clone: RM4-5), anti-FoxP3 antibody (eBioscience, clone: FJK-16s), anti-ICOS antibody (eBioscience, clone: 7E17G9), anti-CCR7 antibody (Biolegend, clone: 4B12), anti-KLRG1 antibody (Biolegend, clone: 2F1/KLRG1). FACS analysis was performed by BD LSR Fortessa X-20 (BD).

(5-4-8) Tumor Treg Evaluation in Hepa1-6/hGPC3 Cell-Transplanted Model

Figure 39:
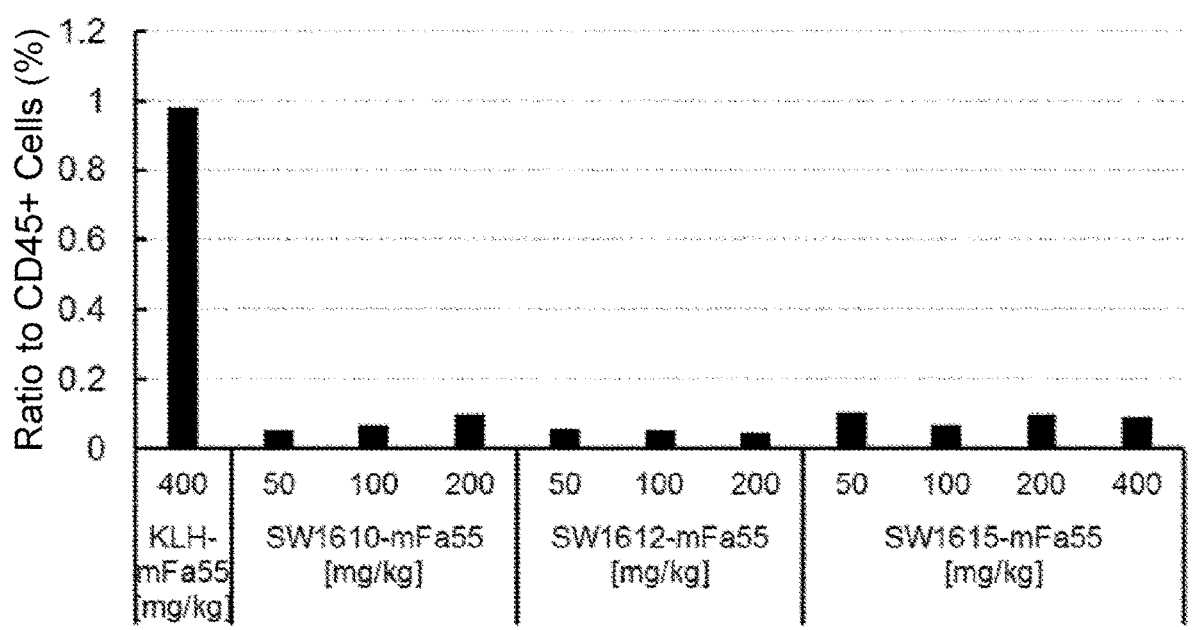
FIG. 39 shows the changes in the ratio of effector Treg cells in a tumor when the anti-CTLA-4 antibody SW1610-mFa55, SW1612-mFa55, or SW1615-mFa55 (all of which are switch antibodies) was administered in a mouse model transplanted with the Hepa1-6/hGPC3 cell line, as described in Reference Example 5-4-8. SW1610-mFa55 was administered at 50 mg/kg, 100 mg/kg, and 200 mg/kg, SW1612-mFa55 was administered at 50 mg/kg, 100 mg/kg, and 200 mg/kg, SW1615-mFa55 was administered at 50 mg/kg, 100 mg/kg, 200 mg/kg, and 400 mg/kg, and the negative control antibody KLH-mFa55 was administered at 400 mg/kg, via the tail vein. The tumor was harvested six days after the administration, and the increase or decrease in effector Treg was evaluated by FACS analysis. The longitudinal axis is the ratio of effector Treg (CD4+ FoxP3+ CCR7low KLRG1+) to CD45+ cells. The mean value of n=3 is shown.

Changes in effector Treg cells (CD4$^+$ FoxP3$^+$ CCR7$^{low}$ KLRG1$^+$) in tumors after administration of anti-CTLA4 switch antibodies were evaluated. As a result, SW1610-mFa55, SW1612-mFa55 and SW1615-mFa55 reduced the ratio of effector Tregs to less than 0.2% of CD45-positive cells in all doses administered (FIG. 39).

(5-4-9) Evaluation of the Systemic Effect in Spleen in Hepa1-6/hGPC3 Cell-Transplanted Model Changes in activated helper T cells (CD4$^+$ Foxp3$^-$ ICOS$^+$) in the spleen after administration of anti-CTLA4 switch antibodies were evaluated by FACS analysis. As a result, the ratio of activated helper T cells to CD45-positive cells in the spleen was not significantly increased at 50 mg/kg of the evaluated doses for SW1610-mFa55 and SW1612-mFa55 and at 200 mg/kg or less of the evaluated doses for SW1615-mFa55. Dunnett's test was performed on the KLH-mFa55-administered group using JMP 11.2.1 (SAS Institute Inc.) for the significance test (FIG. 40). It was confirmed that while all of the switch antibodies showed efficacy, they did not evoke response in tissues other than the tumor, and that they had the property of showing activity only locally in the tumor.

Reference Example 6

Generation of Variant Fc Capable of Enhancing ADCC/ADCP Activity

In order to generate antibodies with enhanced ADCC and ADCP, which are cytotoxic effector functions, preparation of Fc region variants with enhanced binding ability to activating FcγRs FcγRIIIa and FcγRIIa was investigated.

(6-1) Generation and Evaluation of Variants with Enhanced Binding to FcγRs

A heterodimerized antibody, 04H1637-Kn125/04L1610-lam1//04H1637-H1076/04L1610-lam1, which has the heavy chain constant regions Kn125 and H1076 with enhanced binding ability to FcγR described in WO 2013/002362, and has 04H1637 as the heavy chain variable region and 04L1610-lam1 as the light chain, was generated. Specifically, the gene for antibody heavy chain 04H1637-Kn125 (SEQ ID NO: 162) was generated, which comprises 04H1637 (SEQ ID NO: 138) as one heavy chain variable region, and has L234Y/L235Q/G236W/S239M/H268D/D270E/S298A introduced into G1d (SEQ ID NO: 158) with Gly and Lys at the C-terminus of the human IgG1 heavy chain constant region removed, and also has the alterations Y349C/T366W in the CH3 region that promotes heterodimerization. Similarly, the gene for antibody heavy chain 04H1637-H1076 (SEQ ID NO: 163) was generated, which comprises 04H1637 (SEQ ID NO: 138) as the other heavy chain variable region, and has D270E/K326D/A330M/K334E introduced into the human IgG1 heavy chain constant region G1d (SEQ ID NO: 158), and also has the alterations D356C/T366S/L368A/Y407V in the CH3 region that promotes heterodimerization. Using 04L1610-lam1 (SEQ ID NO: 161) as the antibody light chain, the heterodimer 04H1637-Kn125/04L1610-lam1//04H1637-H1076/04L1610-lam1 was generated by a method known to those skilled in the art. The genes of antibody heavy chains 04H1637-Kn462 (SEQ ID NO: 164), 04H1637-H1441 (SEQ ID NO: 165), 04H1637-H1445 (SEQ ID NO: 166), 04H1637-Kn461 (SEQ ID NO: 167), and 04H1637-H1443 (SEQ ID NO: 168) were generated, which, in addition to L235Q, G236W, S239M, H268D, D270E, S298A, K326D, and K334E, have the alterations introduced in the CH2 region L234F and A330K reported in WO 2013/002362 as alterations that change binding to FcγRs; G236A, I332E, and I332D reported in Mol. Cancer Ther., 2008, 7, 2517-2527 and WO 2004/029207; and T250V and T307P reported in WO 2013/118858 as alterations to improve stability, in combination. In addition, the gene for antibody heavy chain 04H1654-KT462 (SEQ ID NO: 182) was generated, which has Gly and Lys at the C-terminus of human IgG1 (IGHG1*03) removed, has the same alterations as Kn462 in the CH2 region, has the alteration E356K that promotes heterodimerization as described in WO 2006/106905 in the CH3 region, and comprises 04H1654 (SEQ ID NO: 140) as the heavy chain variable region. Similarly, the gene for antibody heavy chain 04H1656-HT441 (SEQ ID NO: 170) was generated, which has Gly and Lys at the C-terminus of human IgG1 (IGHG1*03) removed, has the same alterations as H1441 in the CH2 region, has the alteration K439E that promotes heterodimerization as described in WO 2006/106905 in the CH3 region, and comprises 04H1656 (SEQ ID NO: 141) as the heavy chain variable region. Similarly, the genes of 04H1656-HT445 (SEQ ID NO: 171), 04H1654-KT461 (SEQ ID NO: 183), and 04H1656-HT443 (SEQ ID NO: 173) were generated. In addition, a combination of alterations to improve the blood kinetics of the antibodies described in Mabs, 2017, 9, 844-853 was investigated. Specifically, the gene for 04H1654-KT473 (SEQ ID NO: 184) was generated, which has N434A/Y436T/Q438R/S440E introduced into the CH3 region of 04H1654-KT462 (SEQ ID NO: 182), which is a combination of alterations that enhance binding to human FcRn under acidic conditions and alterations that reduce binding to the Rheumatoid factor. Similarly, the gene for 04H1656-HT482 (SEQ ID NO: 185) was generated, which has N434A/Y436T/Q438R/S440E introduced into 04H1656-HT445 (SEQ ID NO: 171). Similarly, antibody heavy chain 04H1654-KT481 (SEQ ID NO: 186) and antibody heavy chain 04H1656-HT498 (SEQ ID NO: 187) were generated by introducing the same alterations into 04H1654-KT461 and 04H1656-HT443, respectively. By combining these heavy chains and using 04L1610-lam1 or 04L1612-lam1 (SEQ ID NO: 188) as the light chain, the desired heterodimerized antibodies were generated.

The extracellular domains of FcγRs were prepared by the following method. First, the genes of the extracellular domains of FcγRs were synthesized by a method known to those skilled in the art. At that time, the sequence of each FcγR was prepared based on the information registered in NCBI. Specifically, FcγRI was prepared based on the sequence of NCBI accession #NM_000566.3, FcγRIIa was prepared based on the sequence of NCBI accession #NM_001136219.1, FcγRIIb was prepared based on the sequence of NCBI accession #NM_004001.3, and FcγRIIIa was prepared based on the sequence of NCBI accession #NM_001127593.1, and a His-tag was added to the C-terminus. The polymorphic site of FcγRIIa was prepared with reference to J. Exp. Med., 1990, 172, 19-25, and the polymorphic site of FcγRIIIa was prepared with reference to J. Clin. Invest., 1997, 100, 1059-1070. Expression vectors were prepared by inserting the obtained gene fragments into animal cell expression vectors. The prepared expression vectors were transiently introduced into human embryonic kidney cancer cell-derived FreeStyle293 cells (Invitrogen) to express the proteins of interest. After the culture supernatants were collected, they were passed through a 0.22 μm filter and purified in the following four steps, in principle. The first step was cation exchange column chromatography (SP Sepharose FF), the second step was affinity column chromatography for His-tag (HisTrap HP), the third step was gel filtration column chromatography (Superdex200), and the fourth step was aseptic filtration. However, for FcγRI, anion exchange column chromatography using Q sepharose FF was performed in the first step. The concentration of the purified protein was calculated by measuring the absorbance at 280 nm using a spectrophotometer and using the extinction coefficient calculated from the obtained value by a method such as PACE (Protein Science, 1995, 4, 2411-2423). Human FcRn was prepared by the method described in WO 2010/107110.

The interaction between the generated antibodies and human FcγRs was analyzed by the following method using Biacore T200. 50 mM Na-Phosphate, 150 mM NaCl, 0.05% Tween20 (pH 7.4) was used as the running buffer, and the assay was performed at 25° C. For the sensor chips, Series S SA (GE Healthcare) chips onto which CaptureSelect Human Fab-lambda Kinetics Biotin Conjugate (Thermo Fisher Scientific) was immobilized were used. The antibodies of interest were captured onto these chips and each FcγR diluted in the running buffer was allowed to interact with them. Chips were regenerated with 10 mM Glycine-HCl (pH 1.5) and 25 mM NaOH, and assay was performed by repeatedly capturing antibodies. The dissociation constants $K_D$ (mol/L) for FcγRs of each antibody were calculated using Biacore T200 Evaluation Software 2.0, using the 1:1 Langmuir binding model for FcγRIa and FcγRIIIa and the steady state affinity model for FcγRIIa. For FcγRIIb, the binding amount of FcγRIIb per unit amount of antibody was calculated by correcting the binding amount of FcγRIIb obtained from the sensorgram obtained by the measurement with the amount of antibody captured onto the chip surface.

The interaction between the generated antibodies and human FcRn was analyzed by the following method using Biacore T200. 50 mM Na-Phosphate, 150 mM NaCl, 0.05% Tween20 (pH 6.0) was used as the running buffer, and the assay was performed at 25° C. For the sensor chip, Series S SA (GE Healthcare) chips onto which CaptureSelect Human Fab-lambda Kinetics Biotin Conjugate (Thermo Fisher Scientific) was immobilized were used. The antibodies of interest were captured onto these chips and FcRn diluted in the running buffer was allowed to interact with them. Chips were regenerated with 10 mM Glycine-HCl (pH 1.5) and 25 mM NaOH, and assay was performed by repeatedly capturing antibodies. The dissociation constant for FcRn of each antibody was calculated using the steady state model, using Biacore T200 Evaluation Software 2.0.

Table 42 shows these measurement results.

Binding Analysis of Fc Region Variants to Human FcγRs and FcRn

TABLE 42

| Antibody name | Substitutions introduced into CH2 domain of Kn or KT heavy chain constant region | Substitutions introduced into CH2 domain of H1 or HT heavy chain constant region | $K_D$ for hFcRn (M) | Relative value to $K_D$ between G1m and hFcRn | $K_D$ for hFcγRs (M) hFcγR Ia | $K_D$ for hFcγRs (M) hFcγR IIa R |
|---|---|---|---|---|---|---|
| 04H1637-G1m/04L1610-lam1 | | | 1.3E−06 | 1.0 | 4.9E−11 | 2.0E−06 |
| 04H1637-Kn125/04L1610-lam1// 04H1637-Hl076/04L1610-lam1 | L234Y/L235Q/G236W/ S239M/H268D/D270E/ S298A | D270E/K326D/A330M/ K334E | N.T | N.T | 4.0E−11 | 1.2E−06 |
| 04H1637-Kn462/04L1610-lam1// 04H1637-Hl441/04L1610-lam1 | L234F/L235Q/G236W/ S239M/T250V/H268D/ D270E/S298A/T307P/ K326D | G236A/T250V/D270E/ S298A/T307P/K326D/ K334E | N.T | N.T | 1.5E−10 | 2.2E−07 |
| 04H1637-Kn462/04L1610-lam1// 04H1637-Hl445/04L1610-lam1 | L234F/L235Q/G236W/ S239M/T250V/H268D/ D270E/S298A/T307P/ K326D | G236A/T250V/D270E/ S298A/T307P/K326D/ A330K/I332D/K334E | N.T | N.T | 7.6E−11 | 1.1E−07 |
| 04H1637-Kn461/04L1610-lam1// 04H1637-Hl443/04L1610-lam1 | L234F/L235Q/G236W/ S239M/T250V/H268D/ D270E/S298A/T307P/ K326D/I332E | G236A/T250V/D270E/ S298A/T307P/K326D/ I332E/K334E | N.T | N.T | 4.2E−11 | 1.9E−07 |
| 04H1654-KT462/04L1610-lam1// 04H1656-HT445/04L1610-lam1 | L234F/L235Q/G236W/ S239M/T250V/H268D/ D270E/S298A/T307P/ K326D | G236A/T250V/D270E/ S298A/T307P/K326D/ A330K/I332D/K334E | 1.5E−06 | 0.9 | 3.0E−11 | 1.6E−07 |
| 04H1654-KT461/04L1610-lam1// 04H1656-HT443/04L1610-lam1 | L234F/L235Q/G236W/ S239M/T250V/H268D/ D270E/S298A/T307P/ K326D/I332E | G236A/T250V/D270E/ S298A/T307P/K326D/ I332E/K334E | 1.5E−06 | 0.9 | 3.2E−11 | 2.4E−07 |
| 04H1654-KT473/04L1610-lam1// 04H1656-HT482/04L1610-lam1 | L234F/L235Q/G236W/ S239M/T250V/H268D/ D270E/S298A/T307P/ K326D | G236A/T250V/D270E/ S298A/T307P/K326D/ A330K/I332D/K334E | 5.8E−07 | 2.3 | 4.6E−11 | 1.5E−07 |

TABLE 42-continued

| | | | | | | | | | |
|---|---|---|---|---|---|---|---|---|---|
| 04H1654-KT481/04L1610-lam1//<br>04H1656-HT498/04L1610-lam1 | L234F/L235Q/G236W/<br>S239M/T250V/H268D/<br>D270E/S298A/T307P/<br>K326D/I332E | G236A/T250V/D270E/<br>S298A/T307P/K326D/<br>I332E/K334E | 5.7E−07 | 2.3 | 3.3E−11 | 2.6E−07 | | | |
| 04H1654-KT462/04L1612-lam1//<br>04H1656-HT445/04L1612-lam1 | L234F/L235Q/G236W/<br>S239M/T250V/H268D/<br>D270E/S298A/T307P/<br>K326D | G236A/T250V/D270E/<br>S298A/T307P/K326D/<br>A330K/I332D/K334E | 1.6E−06 | 0.8 | 4.1E−11 | 1.4E−07 | | | |
| 04H1654-KT461/04L1612-lam1//<br>04H1656-HT443/04L1612-lam1 | L234F/L235Q/G236W/<br>S239M/T250V/H268D/<br>D270E/S298A/T307P/<br>K326D/I332E | G236A/T250V/D270E/<br>S298A/T307P/K326D/<br>I332E/K334E | 1.6E−06 | 0.8 | 3.9E−11 | 2.5E−07 | | | |
| 04H1654-KT473/04L1612-lam1//<br>04H1656-HT482/04L1612-lam1 | L234F/L235Q/G236W/<br>S239M/T250V/H268D/<br>D270E/S298A/T307P/<br>K326D | G236A/T250V/D270E/<br>S298A/T307P/K326D/<br>A330K/I332D/K334E | 6.2E−07 | 2.1 | 4.8E−11 | 1.5E−07 | | | |
| 04H1654-KT481/04L1612-lam1//<br>04H1656-HT498/04L1612-lam1 | L234F/L235Q/G236W/<br>S239M/T250V/H268D/<br>D270E/S298A/T307P/<br>K326D/I332E | G236A/T250V/D270E/<br>S298A/T307P/K326D/<br>I332E/K334E | 6.0E−07 | 2.2 | 4.3E−11 | 2.7E−07 | | | |

| Antibody name | $K_D$ for hFcγRs (M) | | | Binding amount | Relative value to $K_D$ between G1m and hFcγRs | | | | | Relative binding amount |
|---|---|---|---|---|---|---|---|---|---|---|
| | hFcγR IIa H | hFcγR IIIa F | hFcγR IIIa V | hFcγR IIb | hFcγR Ia | hFcγR IIa R | hFcγR IIa H | hFcγR IIIa F | hFcγR IIIa V | hFcγR IIb |
| 04H1637-G1m/04L1610-lam1 | 1.5E−06 | 1.4E−06 | 2.4E−07 | 0.008 | 1.0 | 1.0 | 1.0 | 1.0 | 1.0 | 1.0 |
| 04H1637-Kn125/04L1610-lam1//<br>04H1637-Hl076/04L1610-lam1 | 4.1E−07 | 3.4E−09 | 1.9E−09 | 0.007 | 1.2 | 1.6 | 3.6 | 406.3 | 125.6 | 0.9 |
| 04H1637-Kn462/04L1610-lam1//<br>04H1637-Hl441/04L1610-lam1 | 7.0E−08 | 1.7E−08 | 5.2E−09 | 0.013 | 0.3 | 9.2 | 20.9 | 79.5 | 45.8 | 1.6 |
| 04H1637-Kn462/04L1610-lam1//<br>04H1637-Hl445/04L1610-lam1 | 3.9E−08 | 3.6E−09 | 1.8E−09 | 0.030 | 0.6 | 18.7 | 37.5 | 382.2 | 130.7 | 3.7 |
| 04H1637-Kn461/04L1610-lam1//<br>04H1637-Hl443/04L1610-lam1 | 1.3E−07 | 2.2E−09 | 1.1E−09 | 0.025 | 1.2 | 10.7 | 11.1 | 616.5 | 225.7 | 3.1 |
| 04H1654-KT462/04L1610-lam1//<br>04H1656-HT445/04L1610-lam1 | 1.1E−07 | 3.3E−09 | 2.2E−09 | 0.025 | 1.6 | 13.0 | 13.9 | 414.7 | 109.6 | 3.1 |
| 04H1654-KT461/04L1610-lam1//<br>04H1656-HT443/04L1610-lam1 | 2.0E−07 | 2.6E−09 | 1.5E−09 | 0.025 | 1.5 | 8.4 | 7.3 | 525.5 | 156.1 | 3.1 |
| 04H1654-KT473/04L1610-lam1//<br>04H1656-HT482/04L1610-lam1 | 8.1E−08 | 3.8E−09 | 2.1E−09 | 0.026 | 1.1 | 13.9 | 18.0 | 363.4 | 114.6 | 3.2 |
| 04H1654-KT481/04L1610-lam1//<br>04H1656-HT498/04L1610-lam1 | 2.3E−07 | 2.8E−09 | 1.6E−09 | 0.022 | 1.5 | 7.7 | 6.5 | 495.2 | 152.0 | 2.7 |
| 04H1654-KT462/04L1612-lam1//<br>04H1656-HT445/04L1612-lam1 | 9.1E−08 | 3.4E−09 | 2.3E−09 | 0.028 | 1.2 | 14.2 | 16.1 | 408.0 | 105.7 | 3.4 |
| 04H1654-KT461/04L1612-lam1//<br>04H1656-HT443/04L1612-lam1 | 2.1E−07 | 2.6E−09 | 1.5E−09 | 0.025 | 1.3 | 8.2 | 7.1 | 536.8 | 158.8 | 3.1 |
| 04H1654-KT473/04L1612-lam1//<br>04H1656-HT482/04L1612-lam1 | 9.1E−08 | 3.9E−09 | 2.2E−09 | 0.026 | 1.0 | 13.8 | 16.2 | 354.6 | 110.0 | 3.2 |
| 04H1654-KT481/04L1612-lam1//<br>04H1656-HT498/04L1612-lam1 | 2.3E−07 | 2.9E−09 | 1.7E−09 | 0.022 | 1.1 | 7.6 | 6.4 | 479.2 | 145.2 | 2.8 |

N.T.: Not Tested

The values of "KD for hFcRn (M)" and "KD for hFcγRs (M)" in the table indicate the dissociation constants for hFcRn and each FcγR, respectively, and the "binding amount" shows the binding amount of FcγRIIb per unit amount of antibody when FcγRIIb was allowed to interact at 1000 nM. "Relative value to KD between G1m and hFcRn" and "Relative value to KD between G1m and hFcγRs" are values obtained by dividing the KD value of 04H1637-G1m/04L1610-lam1 for hFcRn and for each FcγR by the KD value of each variant, respectively. "Relative binding amount" indicates the value obtained by dividing the binding amount of each variant to FcγRIIb by the binding amount of 04H1637-G1m/04L1610-lam1. The amino acid sequences of antibody heavy chain 04H1637-G1m and antibody light chain 04L1610-lam1 are shown in SEQ ID NOs: 160 and 161, respectively. It was shown that all of the generated heterodimerized antibodies had enhanced binding to FcγRIIa and FcγRIIIa as compared with 04H1637-G1m/04L1610-lam1 which has the constant region of native human IgG1. Furthermore, 04H1637-Kn462/04L1610-lam1//04H1637-H1441/04L1610-lam1, 04H1637-Kn462/04L1610-lam1//04H1637-H1445/04L1610-lam1, and 04H1637-Kn461/04L1610-lam1//04H1637-H1443/04L1610-lam1 were all shown to have enhanced binding to FcγRIIa compared to 04H1637-Kn125/04L1610-lam1//04H1637-H1076/04L1610-lam1 which has the Fc region variant reported in WO 2013/002362. The binding ability of 04H1637-Kn462/04L1610-lam1//04H1637-H1445/04L1610-lam1 to FcγRIIIa was shown to be equivalent to 04H1637-Kn125/04L1610-lam1//04H1637-H1076/04L1610-lam1 and the binding ability of 04H1637-Kn461/04L1610-lam1//04H1637-H1443/04L1610-lam1 to FcγRIIIa was shown to be enhanced compared to 04H1637-Kn125/04L1610-lam1//04H1637-H1076/04L1610-lam1. Similarly, 04H1654-KT462/04L1610-lam1//04H1656-HT445/04L1610-lam1 and 04H1654-KT462/04L1612-lam1//04H1656-HT445/04L1610-lam1 having different alterations for heterodimerization in the constant region and CH3 region of IGHG1*03 were shown to have a comparable FcγR binding profile to 04H1637-Kn462/04L1610-lam1//04H1637-H1445/04L1610-lam1, and 04H1654-KT461/04L1610-lam1//04H1656-HT443/04L1610-lam1 and 04H1654-KT461/04L1612-lam1//04H1656-HT443/04L1610-lam1 were shown to have a comparable FcγR binding profile to 04H1637-Kn461/04L1610-lam1//04H1637-H1443/04L1610-lam1. In addition, 04H1654-KT473/04L1610-lam1//04H1656-HT482/04L1610-lam1, 04H1654-KT481/04L1610-lam1//04H1656-HT498/04L1610-lam1, 04H1654-KT473/04L1612-lam1//04H1656-HT482/04L1612-lam1, and 04H1654-KT481/04L1612-lam1//04H1656-HT498/04L1612-lam1 introduced with alterations to improve blood kinetics were shown to have improved binding ability to human FcRn and comparable binding ability to FcγRs compared to those of the antibodies before the introduction of the alterations to improve blood kinetics.

In addition, the gene of 04H1656-HT451 (SEQ ID NO: 272) was generated, in which N434A/Y436T/Q438R/S440E was introduced into 04H1656-HT441, which is a combination of alterations that enhance binding to human FcRn under acidic conditions and alterations that reduce binding to the Rheumatoid factor. The amino acid sequence of the antibody heavy chain HT451 is shown in SEQ ID NO: 276. A heterodimerized antibody was generated by combining 04H1654-KT473 and 04H1656-HT451 and using 04L1610-lam1 as the antibody light chain. Table 43 shows the results of the interaction analysis of the generated antibodies with human FcRn and with human FcγRs.

Binding Analysis of Fc Region Variants to Human FcγRs and FcRn antibodies. 04H1654-KT473/04L1610-lam1//04H1656-HT451/04L1610-lam1, in which N434A/Y436T/Q438R/S440E was introduced into 04H1654-KT462/04L1610-lam1//04H1656-HT441/04L1610-lam1, was shown to have enhanced binding ability to human FcRn compared to that before the introduction of the alterations.

Next, the FcγR binding-enhanced variants generated using the different alterations for heterodimerization described in Nat. Biotechnol., 1998, 16, 677-681 were evaluated for their binding activity to human FcRn and FcγRs. The genes of antibody heavy chains 04H1389-Ks462 (SEQ ID NO: 191) and 04H1389-Km462 (SEQ ID NO: 199) were generated, which comprise 04H1389 (SEQ ID NO: 136) as a heavy chain variable region, and have a heavy chain constant region which has the same alterations as KT462 introduced into the CH2 region of the constant region with Gly and Lys at the C-terminus of human IgG1 (IGHG1*03) removed, and further has in the CH3 region, T366W introduced as an alteration for heterodimerization for 04H1389-Ks462, and Y349C/T366W used as alterations for heterodimerization for 04H1389-Km462. In addition, the genes for antibody heavy chains 04H1389-Hs445 (SEQ ID NO: 192) and 04H1389-Hm445 (SEQ ID NO: 200) were generated, which have the same alterations as HT445 introduced into the CH2 region, and further have in the CH3 region, T366S/L368A/Y407V introduced as alterations for heterodimerization for 04H1389-Hs445, and E356C/T366S/L368A/Y407V used as alterations for heterodimerization for 04H1389-Hm445. Similarly, 04H1389-Ks461 (SEQ ID NO: 193), 04H1389-Km461 (SEQ ID NO: 201), 04H1389-Hs443 (SEQ ID NO: 194), and 04H1389-Hm443 (SEQ ID NO: 202), which have the same alterations as KT461 and

TABLE 43

| Antibody name | $K_D$ for hFcRn (M) | Relative value to KD between G1m and hFcRn | $K_D$ for hFcγRs (M) | | | | |
|---|---|---|---|---|---|---|---|
| | | | hFcγR Ia | hFcγR IIa R | hFcγR IIa H | hFcγR IIIa F | hFcγR IIIa V |
| 04H1656-G1m/04L1610-lam1 | 1.7E−06 | 1.0 | 9.2E−11 | 1.6E−06 | 1.3E−06 | 1.0E−06 | *9.7E−07 |
| 04H1654-KT462/04L1610-lam1//04H1656-HT441/04L1610-lam1 | 2.0E−06 | 0.9 | 1.2E−10 | 1.8E−07 | 9.9E−08 | 1.7E−08 | 4.4E−09 |
| 04H1654-KT473/04L1610-lam1//04H1656-HT451/04L1610-lam1 | 5.4E−07 | 3.2 | 1.4E−10 | 1.8E−07 | 9.2E−08 | 2.0E−08 | 5.1E−09 |

| Antibody name | Binding amount hFcγR IIb | Relative value to $K_D$ between G1m and hFcγRs | | | | | Relative binding amount hFcγR IIb |
|---|---|---|---|---|---|---|---|
| | | hFcγR Ia | hFcγR IIa R | hFcγR IIa H | hFcγR IIIa F | hFcγR IIIa V | |
| 04H1656-G1m/04L1610-lam1 | 0.008 | 1.0 | 1.0 | 1.0 | 1.0 | 1.0 | 1.0 |
| 04H1654-KT462/04L1610-lam1//04H1656-HT441/04L1610-lam1 | 0.014 | 0.8 | 9.0 | 13.5 | 58.1 | 218.3 | 1.7 |
| 04H1654-KT473/04L1610-lam1//04H1656-HT451/04L1610-lam1 | 0.012 | 0.6 | 8.9 | 14.5 | 50.8 | 190.3 | 1.5 |

*KD value was determined by the steady state model.

The generated heterodimerized antibodies 04H1654-KT462/04L1610-lam1//04H1656-HT441/04L1610-lam1 and 04H1654-KT473/04L1610-lam1//04H1656-HT451/04L1610-lam1 were both shown to have enhanced binding to activating FcγRs FcγRIIa and FcγRIIIa, compared to 04H1656-G1m/04L1610-lam1 which has the constant region of the native human IgG1. In addition, the binding to FcγRIIb, which is an inhibitory FcγR, was maintained at the same level as 04H1656-G1m/04L1610-lam1 in both of these HT443 in the CH2 region, were generated. In addition, genes for antibody heavy chains 04H1389-Ks473 (SEQ ID NO: 195), 04H1389-Hs482 (SEQ ID NO: 196), 04H1389-Ks481 (SEQ ID NO: 197), 04H1389-Hs498 (SEQ ID NO: 198), 04H1389-Km473 (SEQ ID NO: 203), 04H1389-Hm482 (SEQ ID NO: 204), 04H1389-Km481 (SEQ ID NO: 205), and 04H1389-Hm498 (SEQ ID NO: 206) were generated, which have the alterations N434A/Y436T/Q438R/S440E that improve blood kinetics introduced into the above antibody heavy chain constant regions Ks462, Hs445, Ks461, Hs443, Km462, Hm445, Km461, and Hm443, and have 04H1389 as a variable region. 04L1615-k0MT (SEQ ID NO: 190) was used as the light chain, and heterodimers of interest were generated. For comparison, the homodimer 04H1389-G1m/04L16150k0MT having 04H1389-G1m (SEQ ID NO: 189) was generated. The interaction between the generated antibodies and human FcγRs was analyzed using Biacore T200. 50 mM Na-Phosphate, 150 mM NaCl, 0.05% Tween20 (pH 7.4) was used as the running buffer, and the assay was performed at 25° C. For the sensor chip, Series S SA (GE Healthcare) chips onto which CaptureSelect Human Fab-kappa Kinetics Biotin Conjugate (Thermo Fisher Scientific) was immobilized were used. The antibodies of interest were captured onto these chips and each FcγR diluted in the running buffer was allowed to interact with them. Chips were regenerated with 10 mM Glycine-HCl (pH 1.5) and 25 mM NaOH, and assay was performed by repeatedly capturing antibodies. The dissociation constants $K_D$ (mol/L) for FcγRs of each antibody were calculated using Biacore T200 Evaluation Software 2.0, and using the 1:1 Langmuir binding model for FcγRIa and FcγRIIIa and the steady state affinity model for FcγRIIa. For FcγRIIb, the binding amount of FcγRIIb per unit amount of antibody was calculated by correcting the binding amount of FcγRIIb obtained from the sensorgram obtained by the measurement with the amount of antibody captured onto the chip surface. For the measurement of binding to FcRn, 50 mM Na-Phosphate, 150 mM NaCl, 0.05% Tween20 (pH 6.0) was used as the running buffer, and the dissociation constant $K_D$ (mol/L) was calculated by the steady state model (Table 44). Of the dissociation constants for FcγRIIIa in Table 44, the values indicated by the "*" are the values calculated by the steady state affinity model.

Analysis of the Binding of the Fc Region Variants to Human FcγRs and FcRn

TABLE 44

| Antibody name | $K_D$ for hFcRn (M) | Relative value to $K_D$ between G1m and hFcRn | $K_D$ for hFcγRs (M) | | | | |
|---|---|---|---|---|---|---|---|
| | | | hFcγR Ia | hFcγR IIa R | hFcγR IIa H | hFcγR IIIa F | hFcγR IIIa V |
| 04H1389-G1m/04L1615-k0MT | 1.3E−06 | 1.0 | 4.5E−11 | 1.5E−06 | 1.1E−06 | N.T. | *9.1E−07 |
| 04H1389-Ks462/04L1615-k0MT//04H1389-Hs445/04L1615-k0MT | 1.6E−06 | 0.8 | 4.7E−11 | 1.6E−07 | 6.7E−08 | 2.1E−09 | 1.1E−09 |
| 04H1389-Ks461/04L1615-k0MT//04H1389-Hs443/04L1615-k0MT | 1.7E−06 | 0.8 | 3.0E−11 | 2.5E−07 | 1.6E−07 | 1.2E−09 | 5.6E−10 |
| 04H1389-Ks473/04L1615-k0MT//04H1389-Hs482/04L1615-k0MT | 4.5E−07 | 2.9 | 5.1E−11 | 1.6E−07 | 7.5E−08 | 2.3E−09 | 1.2E−09 |
| 04H1389-Ks481/04L1615-k0MT//04H1389-Hs498/04L1615-k0MT | 4.6E−07 | 2.8 | 2.8E−11 | 2.6E−07 | 1.9E−07 | 1.3E−09 | 6.0E−10 |
| 04H1389-Km462/04L1615-k0MT//04H1389-Hm445/04L1615-k0MT | 1.7E−06 | 0.8 | 4.8E−11 | 1.6E−07 | 7.4E−08 | 2.2E−09 | 1.1E−09 |
| 04H1389-Km461/04L1615-k0MT//04H1389-Hm443/04L1615-k0MT | 1.7E−06 | 0.7 | 2.5E−11 | 2.6E−07 | 1.9E−07 | 1.2E−09 | 5.6E−10 |
| 04H1389-Km473/04L1615-k0MT//04H1389-Hm482/04L1615-k0MT | 4.6E−07 | 2.8 | 6.2E−11 | 1.8E−07 | 8.7E−08 | 2.6E−09 | 1.3E−09 |
| 04H1389-Km481/04L1615-k0MT//04H1389-Hm498/04L1615-k0MT | 4.7E−07 | 2.8 | 4.2E−11 | 2.9E−07 | 2.1E−07 | 1.4E−09 | 6.2E−10 |

| Antibody name | Binding amount hFcγR IIb | Relative value to $K_D$ between G1m and hFcγRs | | | | Relative binding amount hFcγR IIb |
|---|---|---|---|---|---|---|
| | | hFcγR Ia | hFcγR IIa R | hFcγR IIa H | hFcγR IIIa V | |
| 04H1389-G1m/04L1615-k0MT | 0.011 | 1.0 | 1.0 | 1.0 | 1.0 | 1.0 |
| 04H1389-Ks462/04L1615-k0MT//04H1389-Hs445/04L1615-k0MT | 0.030 | 1.0 | 9.1 | 15.8 | 829.9 | 2.6 |
| 04H1389-Ks461/04L1615-k0MT//04H1389-Hs443/04L1615-k0MT | 0.024 | 1.5 | 5.9 | 6.7 | 1627.2 | 2.1 |
| 04H1389-Ks473/04L1615-k0MT//04H1389-Hs482/04L1615-k0MT | 0.026 | 0.9 | 9.0 | 14.1 | 760.2 | 2.3 |
| 04H1389-Ks481/04L1615-k0MT//04H1389-Hs498/04L1615-k0MT | 0.023 | 1.6 | 5.6 | 5.6 | 1500.7 | 2.0 |
| 04H1389-Km462/04L1615-k0MT//04H1389-Hm445/04L1615-k0MT | 0.029 | 0.9 | 9.5 | 14.4 | 810.6 | 2.6 |
| 04H1389-Km461/04L1615-k0MT//04H1389-Hm443/04L1615-k0MT | 0.024 | 1.8 | 5.8 | 5.7 | 1620.3 | 2.1 |
| 04H1389-Km473/04L1615-k0MT//04H1389-Hm482/04L1615-k0MT | 0.024 | 0.7 | 8.2 | 12.3 | 705.1 | 2.1 |
| 04H1389-Km481/04L1615-k0MT//04H1389-Hm498/04L1615-k0MT | 0.021 | 1.1 | 5.1 | 5.0 | 1469.1 | 1.9 |

*: KD value was determined by the steady state model.
NT: Not Tested

All of the heterodimerized antibodies generated here had enhanced binding activity to FcγRIIa and FcγRIIIa as compared with 04H1389-G1m/04L1615-k0MT. In addition, all of 04H1389-Ks473/04L1615-k0MT//04H1389-Hs482/04L1615-k0MT, 04H1389-Ks481/04L1615-k0MT//

04H1389-Hs498/04L1615-k0MT, 04H1389-Km473/04L1615-k0MT//04H1389-Hm482/04L1615-k0MT, and 04H1389-Km481/04L1615-k0MT//04H1389-Hm498/04L1615-k0MT, which have alterations introduced to improve the blood kinetics of the antibodies, had enhanced binding activity to human FcRn as compared with the parent antibody before the introduction of the alterations, and for the FcγR binding activity, they had the same binding profile as the parent antibody.

Furthermore, the gene for 04H1389-Hm441 (SEQ ID NO: 273), which comprises 04H1389 (SEQ ID NO: 136) as the heavy chain variable region, has the same alterations as HT441 introduced into the heavy chain CH2 region, and has Y349C/366W used as alterations for heterodimerization in the CH3 region, was generated. In contrast, 04H1389-Hm451 (SEQ ID NO: 274) was generated, with N434A/Y436T/Q438R/S440E introduced, which is a combination of alterations that enhance binding to human FcRn under acidic conditions and alterations that reduce binding to the Rheumatoid factor. The amino acid sequences of the antibody heavy chains Hm441 and Hm451 are shown in SEQ ID NOs: 277 and 278, respectively. Heterodimerized antibodies were generated using 04H1389-Km473, 04H1389-Hm451 or 04H1389-Hm482 as the antibody heavy chain and 04L1305-k0MT as the antibody light chain. Table 45 shows the results of the interaction analysis of the generated antibodies with human FcRn and with human FcγRs.

Analysis of the Binding of Fc Region Variants to Human FcγRs and to FcRn k0MT and 04H1389-Km473/04L1305-k0MT//04H1389-Hm482/04L1305-k0MT were both shown to have enhanced binding to the activating FcγRs FcγRIIa and FcγRIIIa compared with 04H1389-G1m/04L1305-k0MT having a constant region of native human IgG1. It was also shown that both of these antibodies have enhanced binding ability to human FcRn as compared with 04H1389-G1m/04L1305-k0MT.

Next, constant region variants with enhanced binding to FcγRs found here were compared with existing FcγR binding-enhanced variants. The genes for antibody heavy chains MDX10D1H-Kn125 (SEQ ID NO: 217), MDX10D1H-H1076 (SEQ ID NO: 218), MDX10D1H-Kn462 (SEQ ID NO: 219), MDX10D1H-H1445 (SEQ ID NO: 220), MDX10D1H-Kn461 (SEQ ID NO: 221), and MDX10D1H-H1443 (SEQ ID NO: 222), which comprise MDX10D1H (SEQ ID NO: 154) as the heavy chain variable region, and the heavy chain constant regions listed in Table 42, and the gene for MDX10D1H-G1m (SEQ ID NO: 210) comprising the CH2 region of native human IgG1, were generated. The gene for the antibody heavy chain MDX10D1H-GASDIE (SEQ ID NO: 215) was generated, which has the alterations G236A/S239D/I332E in the CH2 region as described in Mol. Cancer Ther., 2008, 7, 2517-2527 as a variant with enhanced binding to FcγRIIa. Furthermore, the gene for the antibody heavy chain MDX10D1H-GASDALIE (SEQ ID NO: 216) was also generated, which has G236A/S239D/A330L/I332E in the CH2 region as described in J. Struct. Biol., 2016, 194, 78-89 as a variant with enhanced binding to FcγRIIIa. MDX10D1L-k0MT (SEQ ID NO: 211) was used as the antibody light chain, and the antibodies of interest were generated. The binding activity of these antibodies to human FcγRs was measured by the above-described method using CaptureSelect Human Fab-kappa Kinetics Biotin Conjugate (Table 46).

TABLE 45

| Antibody name | $K_D$ for hFcRn (M) | Relative value to KD between G1m and hFcRn | $K_D$ for hFcγRs (M) | | | | |
|---|---|---|---|---|---|---|---|
| | | | hFcγR Ia | hFcγR IIa R | hFcγR IIa H | hFcγR IIIa F | hFcγR IIIa V |
| 04H1389-G1m/04L1305-k0MT | 1.0E−06 | 1.0 | 6.9E−11 | 1.6E−06 | 1.1E−06 | 6.9E−07 | *8.8E−07 |
| 04H1389-Km473/04L1305-k0MT//04H1389-Hm451/04L1305-k0MT | 3.3E−07 | 3.0 | 1.5E−10 | 1.6E−07 | 5.3E−08 | 1.7E−08 | 3.9E−09 |
| 04H1389-Km473/04L1305-k0MT//04H1389-Hm482/04L1305-k0MT | 3.7E−07 | 2.7 | 6.1E−11 | 8.6E−08 | 3.5E−08 | 2.7E−09 | 9.5E−10 |

| Antibody name | Binding amount hFcγR IIb | Relative value to $K_D$ between G1m and hFcγRs | | | | | Relative binding amount hFcγR IIb |
|---|---|---|---|---|---|---|---|
| | | hFcγR Ia | hFcγR IIa R | hFcγR IIa H | hFcγR IIIa F | hFcγR IIIa V | |
| 04H1389-G1m/04L1305-k0MT | 0.011 | 1.0 | 1.0 | 1.0 | 1.0 | 1.0 | 1.0 |
| 04H1389-Km473/04L1305-k0MT//04H1389-Hm451/04L1305-k0MT | 0.015 | 0.5 | 9.7 | 20.0 | 41.3 | 224.7 | 1.3 |
| 04H1389-Km473/04L1305-k0MT//04H1389-Hm482/04L1305-k0MT | 0.034 | 1.1 | 18.5 | 30.8 | 258.1 | 930.5 | 3.0 |

*KD value was determined by the steady state model.

The generated heterodimerized antibodies 04H1389-Km473/04L1305-k0MT//04H1389-Hm451/04L1305-

Analysis of the Binding of the Fc Region Variants to Human FcγRs

TABLE 46

| Antibody name | $K_D$ for hFcγRs (M) | | | |
|---|---|---|---|---|
| | hFcγR IIa R | hFcγR IIa H | hFcγR IIIa F | hFcγR IIIa V |
| MDX10D1H-G1m/MDX10D1L-k0MT | 1.5E−06 | 1.0E−06 | N.T. | *9.5E−07 |
| MDX10D1H-GASDIE/MDX10D1L-k0MT | 6.1E−08 | 5.5E−08 | 2.3E−08 | 1.4E−08 |
| MDX10D1H-GASDALIE/MDX10D1L-k0MT | 7.9E−07 | 9.7E−07 | 1.2E−08 | 6.9E−09 |
| MDX10D1H-Kn125/MDX10D1H-Hl076/MDX10D1L-k0MT | 9.6E−07 | 2.7E−07 | 1.9E−09 | 1.1E−09 |
| MDX10D1H-Kn462/MDX10D1H-Hl445/MDX10D1L-k0MT | 1.0E−07 | 2.8E−08 | 2.7E−09 | 1.2E−09 |
| MDX10D1H-Kn461/MDX10D1H-Hl443/MDX10D1L-k0MT | 1.7E−07 | 8.8E−08 | 1.4E−09 | 5.7E−10 |

| Antibody name | Binding amount | Relative value to $K_D$ between G1m and hFcγRs | | | Relative binding amount |
|---|---|---|---|---|---|
| | hFcγR IIb | hFcγR IIa R | hFcγR IIa H | hFcγR IIIa V | hFcγR IIb |
| MDX10D1H-G1m/MDX10D1L-k0MT | 0.012 | 1.0 | 1.0 | 1.0 | 1.0 |
| MDX10D1H-GASDIE/MDX10D1L-k0MT | 0.072 | 24.2 | 18.9 | 68.2 | 5.8 |
| MDX10D1H-GASDALIE/MDX10D1L-k0MT | 0.044 | 1.9 | 1.1 | 138.1 | 3.6 |
| MDX10D1H-Kn125/MDX10D1H-Hl076/MDX10D1L-k0MT | 0.009 | 1.5 | 3.8 | 898.8 | 0.7 |
| MDX10D1H-Kn462/MDX10D1H-Hl445/MDX10D1L-k0MT | 0.037 | 14.9 | 37.3 | 807.1 | 3.0 |
| MDX10D1H-Kn461/MDX10D1H-Hl443/MDX10D1L-k0MT | 0.031 | 9.0 | 11.8 | 1676.4 | 2.5 |

*KD value was determined by the steady state model.
N.T.; Not Tested

The value of "KD for hFcγRs (M)" in the table indicates the dissociation constant for each of the listed FcγRs, and the "Binding amount" indicates the binding amount of FcγRIIb per unit amount of antibody when FcγRIIb was allowed to interact at 1000 nM. The "Relative value to KD between G1m and hFcγRs" indicates the value obtained by dividing the KD value of MDX10D1H-G1m/MDX10D1L-k0MT for each FcγR by the KD value of each variant, and the "Relative binding amount" indicates the value obtained by dividing the binding amount of each variant to FcγRIIb by the binding amount of MDX10D1H-G1m/MDX10D1L-k0MT.

The generated heterodimers, MDX10D1H-Kn125/MDX10D1H-H1076/MDX10D1L-k0MT, MDX10D1H-Kn462/MDX10D1H-H1445/MDX10D1L-k0MT, and MDX10D1H-Kn461/MDX10D1H-H1443/MDX10D1L-k0MT all had enhanced binding to FcγRIIIa compared with the existing FcγR binding-enhanced antibodies MDX10D1H-GASDIE/MDX10D1L-k0MT and MDX10D1H-GASDALIE/MDX10D1L-k0MT. It was also shown that MDX10D1H-Kn462/MDX10D1H-H1445/MDX10D1L-k0MT had about 2-fold enhanced binding to FcγRIIaH as compared with the existing FcγRIIa-enhanced antibody MDX10D1H-GASDIE/MDX10D1L-k0MT.

(6-2) Evaluation of In Vitro ADCC Activity of Various Antibodies Having Altered Constant Regions hFcγRIIIaV ADCC Reporter Bioassay, Core Kit (Promega) was used for in vitro ADCC activity assay. To each well of a 96-well plate, 25 μL of hCTLA4-CHO cells with concentration prepared to 2×10⁶/mL using the medium was added as target cells, and Assay Buffer (90% RPMI1640, 10% FBS) was used as the medium. Next, 25 μL of each antibody solution diluted with the Assay Buffer was added so that the final concentration was 0, 0.001, 0.01, 0.1, and 1 μg/mL. Lastly, 25 μL of hFcγRIIIaV-expressing Jurkat cells (included in the kit) prepared to 6×10⁶/mL with the medium was added as the effector cell solution, so that the solutions were mixed to a total of 75 μL. The plate was left to stand at 37° C. overnight in a 5% $CO_2$ incubator. The plate was then left to stand at room temperature for 15 minutes and 75 μL of Bio-Glo reagent was added to each well. The Bio-glo Luciferase Assay System (Buffer and Substrate) was used as the Bio-Glo reagent. The luminescence of each well was then measured with a plate reader. The value obtained by dividing the luminescence value of each well by the luminescence value of antibody-free wells was defined as Fold induction, which was used as an index for evaluating the ADCC of each antibody. The results obtained are shown in FIG. 41. In the figure, Fold induction is represented as relative luminescence units (RLU).

These results showed that the ADCC activity of antibodies having an altered Fc against hCTLA4-CHO cells is stronger than that of the wild type human IgG1 constant region.

(6-3) Evaluation of In Vitro ADCP Activity of Various Antibodies Having Altered Constant Regions hFcγRIIaH ADCP Reporter Bioassay, Core Kit (Promega) was used for the in vitro ADCP activity assay. To each well of a 96-well plate, 25 μL of hCTLA4-CHO cells with concentration prepared to 1×10⁶/mL using the medium was added as target cells, and Assay Buffer (4% Low IgG serum in RPMI1640) was used as the medium. Next, 25 μL of each antibody solution diluted with the Assay Buffer was added so that the final concentration was 0, 0.001, 0.01, 0.1, and 1 μg/mL. Lastly, 25 μL of hFcγRIIaH-expressing Jurkat cells included in the kit was added as an effector cell solution, so that the solutions were mixed to a total of 75 μL. The plate was left to stand at 37° C. overnight in a 5% $CO_2$ incubator. The cell solution density of hFcγRIIaH-expressing Jurkat cells was 8.25×10⁵/mL. The plate was then left to stand at room temperature for 15 minutes and 75 μL of Bio-Glo reagent was added to each well. The Bio-Glo Luciferase Assay System (Buffer and Substrate) was used as the Bio-Glo reagent. The luminescence of each well was then measured with a plate reader. The value obtained by dividing the luminescence value of each well by the luminescence value of the antibody-free wells was defined as Fold induction, which was used as an index for evaluating ADCP of each antibody. The results obtained are shown in FIG. 42. In the figure, Fold induction is represented as relative luminescence units (RLU).

The results showed that the ADCP activity of antibodies having an altered Fc against hCTLA4-CHO cells is stronger than that of the wild type human IgG1 constant region.

(6-4) Evaluation of In Vitro ADCC Activity of Anti-CTLA4 Switch Antibodies Having an Altered Fc Anti-CTLA4 switch antibodies with an altered Fc (04H1654-Kn462/04L1610-lam1//04H1656-H1445/04L1610-lam1, abbreviation: SW1610-ART6; 04H1654-Kn462/04L1612-lam1//04H1656-H1445/04L1612-lam1, abbreviation: SW1612-ART6; and 04H1389-Kn462/04L1305-k0MT//04H1389-H1445/04L1305-k0MT, abbreviation: SW1389-ART6) were generated.

In the SW1610-ART6 antibody, one heavy chain variable region 04H1654 (SEQ ID NO: 35) was linked to the human heavy chain constant region Kn462 (SEQ ID NO: 43), the other heavy chain variable region 04H1656 (SEQ ID NO: 37) was linked to the human heavy chain constant region H1445 (SEQ ID NO: 44) as constant region, and for the light chain variable region 04L1610 (SEQ ID NO: 39), the wild type human light chain constant region lam1 (SEQ ID NO: 53) was used. The antibody was expressed and purified by a method known to those skilled in the art.

In the SW1612-ART6 antibody, one heavy chain variable region 04H1654 (SEQ ID NO: 35) was linked to the human heavy chain constant region Kn462 (SEQ ID NO: 43), the other heavy chain variable region 04H1656 (SEQ ID NO: 37) was linked to the human heavy chain constant region H1445 (SEQ ID NO: 44) as constant region, and for the light chain variable region 04L1612 (SEQ ID NO: 40), the wild type human light chain constant region lam1 (SEQ ID NO: 53) was used. The antibody was expressed and purified by a method known to those skilled in the art.

In the SW1389-ART6 antibody, two heavy chain variable regions 04H1389 (SEQ ID NO: 29) were linked respectively with the human heavy chain constant region Kn462 (SEQ ID NO: 43), and the human heavy chain constant region H1445 (SEQ ID NO: 44) as constant region, and further for the light chain variable region 04L1305 (SEQ ID NO: 30), the wild type human light chain constant region k0MT (SEQ ID NO: 33) was used. The antibody was expressed and purified by a method known to those skilled in the art.

hFcγRIIIaV ADCC Reporter Bioassay, Core Kit (Promega) was used for the in vitro ADCC activity assay. To each well of a 96-well plate, 12.5 μL of hCTLA4-CHO cells with concentration prepared to $2\times10^6$/mL by the medium was added as target cells, and Assay Buffer (4% Low IgG Serum in RPMI1640) was used as the medium. Next, ATP solutions diluted with the Assay Buffer so that the final concentration was 0 and 100 μM, and SW1389-ART6, SW1610-ART6 and SW1612-ART6 antibody solutions diluted with the Assay Buffer so that the final concentration was 0, 0.001, 0.01, 0.1, 1, and 10 μg/mL, were added sequentially. Lastly, 25 μL of hFcγRIIIaV-expressing Jurkat cells (included in the kit) prepared to $3\times10^6$/mL with the medium was added as an effector cell solution, and the solutions were mixed to a total of 75 μL. The plate was left to stand at 37° C. for 6 hours in a 5% $CO_2$ incubator. The plate was then left to stand at room temperature for 15 minutes and 75 μL of Bio-Glo reagent was added to each well. The Bio-Glo Luciferase Assay System (Buffer and Substrate) was used as the Bio-Glo reagent. The luminescence of each well was then measured with a plate reader. The value obtained by dividing the luminescence value of each well by the luminescence value of the antibody-free wells was defined as Fold induction, which was used as an index for evaluating ADCC of each antibody. The results obtained are shown in FIG. 43 (SW1389-ART6), FIG. 44 (SW1610-ART6), and FIG. 45 (SW1612-ART6). In the figures, Fold induction is represented as relative luminescence units (RLU).

From these results, it was confirmed that the ADCC activity of the anti-CTLA4 switch antibodies having an altered Fc against hCTLA4-CHO cells differs between the presence and absence of ATP, and that there was ATP-dependent cytotoxicity against hCTLA4-CHO cells.

(6-5) Evaluation of In Vitro Neutralizing Activity of Anti-CTLA4 Switch Antibodies As altered anti-CTLA4 switch antibodies, human antibodies having variable regions of SW1389, SW1610, SW1612, and SW1615 were produced.

For the SW1389 antibody, 04H1389 (SEQ ID NO: 29) was used as the heavy chain variable region and 04L1305 (SEQ ID NO: 30) was used as the light chain variable region. After the variable regions were linked to the human constant regions, the antibody was expressed and purified by a method known to those skilled in the art.

For the SW1610 antibody, 04H1654 (SEQ ID NO: 35) and 04H1656 (SEQ ID NO: 37) were used as the heavy chain variable region, and 04L1610 (SEQ ID NO: 39) was used as the light chain variable region. After the variable regions were linked to the human constant regions, the antibody was expressed and purified by a method known to those skilled in the art.

For the SW1612 antibody, 04H1654 (SEQ ID NO: 35) and 04H1656 (SEQ ID NO: 37) were used as the heavy chain variable region, and 04L1612 (SEQ ID NO: 40) was used as the light chain variable region. After the variable regions were linked to the human constant regions, the antibody was expressed and purified by a method known to those skilled in the art.

For the SW1615 antibody, 04H1389 (SEQ ID NO: 29) was used as the heavy chain variable region and 04L1615 (SEQ ID NO: 34) was used as the light chain variable region. After the variable regions were linked to the human constant regions, the antibody was expressed and purified by a method known to those skilled in the art.

CTLA-4 Blockade Bioassay (Promega) was used to measure the in vitro neutralizing activity. To each well of a 96-well plate, 25 μL of aAPC-Raji cells attached to the Kit with concentration prepared to $1\times10^6$/mL by the medium was added as target cells, and Assay Buffer (10% FBS in RPMI1640) was used as the medium. Next, ATP solutions diluted with the Assay Buffer so that the final concentration was 0 and 100 μM, and then antibody solutions having variable regions of SW1389, SW1610, SW1612 and SW1615 diluted with the Assay Buffer so that the final concentration was 0, 0.001, 0.01, 0.1, 1, and 10 μg/mL were added sequentially. Lastly, 25 μL of IL2-luc2-CTLA4-Jurkat cells (included in the kit) prepared to $2\times10^6$/mL with the medium was added as an effector cell solution, so that the solution was mixed to a total of 75 μL. The plate was left to stand at 37° C. for 6 hours in a 5% $CO_2$ incubator. The plate was then left to stand at room temperature for 15 minutes and 75 μL of Bio-Glo reagent was added to each well. The Bio-Glo Luciferase Assay System (buffer and substrate) was used as the Bio-Glo reagent. The luminescence of each well was then measured with a plate reader. The value obtained by dividing the luminescence value of each well by the luminescence value of the antibody-free wells was defined as Fold induction, which was used as an index for evaluating the neutralizing activity of each antibody. The results obtained are shown in FIG. 46 (SW1389), FIG. 47 (SW1610), FIG. 48 (SW1612) and FIG. 49 (SW1615). In the figures, Fold induction is represented as relative luminescence units (RLU).

From these results, it was confirmed that the neutralizing activity of the anti-CTLA4 switch antibodies against hCTLA4-expressing cells was different between the presence and absence of ATP, and that there was ATP-dependent neutralizing activity.

(6-6) Evaluation of In Vitro Cytotoxic Activity of Anti-CTLA4 Switch Antibodies Against CTLA4-Positive Regulatory T Cells Anti-CTLA4 switch antibodies with an altered Fc (04H1654-KT473/04L1610-lam1//04H1656-HT451/ 04L1610-lam1, abbreviation: SW1610-ART5+ACT1; 04H1654-KT473/04L1610-lam1//04H1656-HT482/ 04L1610-lam1, abbreviation: SW1610-ART6+ACT1; 04H1389-Km473/04L1305-k0MT//04H1389-Hm451/ 04L1305-k0MT, abbreviation: SW1389-ART5+ACT1; 04H1389-Km473/04L1305-k0MT//04H1389-Hm482/ 04L1305-k0MT, abbreviation: SW1389-ART6+ACT1) were generated.

For the SW1610-ART5+ACT1 antibody, 04H1654-KT473 (SEQ ID NO: 184) was used as one heavy chain, 04H1656-HT451 (SEQ ID NO: 272) was used as the other heavy chain, and 04L1610-lam1 (SEQ ID NO: 161) was used as the light chain. The antibody was expressed and purified by a method known to those skilled in the art.

For the SW1610-ART6+ACT1 antibody, 04H1654-KT473 (SEQ ID NO: 184) was used as one heavy chain, 04H1656-HT482 (SEQ ID NO: 185) was used as the other heavy chain, and 04L1610-lam1 (SEQ ID NO: 161) was used as the light chain. The antibody was expressed and purified by a method known to those skilled in the art.

For the SW1389-ART5+ACT1 antibody, 04H1389-Km473 (SEQ ID NO: 203) was used as one heavy chain, 04H1389-Hm451 (SEQ ID NO: 274) was used as the other heavy chain, and 04L1305-k0MT (SEQ ID NO: 275) was used as the light chain. The antibody was expressed and purified by a method known to those skilled in the art.

For the SW1389-ART6+ACT1 antibody, 04H1389-Km473 (SEQ ID NO: 203) was used as one heavy chain, 04H1389-Hm482 (SEQ ID NO: 204) was used as the other heavy chain, and 04L1305-k0MT (SEQ ID NO: 275) was used as the light chain. The antibody was expressed and purified by a method known to those skilled in the art.

The in vitro cytotoxic activity of the generated anti-CTLA4 switch antibodies with an altered Fc against CTLA4-positive regulatory T cells (CD3$^+$ CD4$^+$ CD25$^+$ CD45RA$^-$ CTLA4$^+$) was evaluated. First, human PBMCs (CTL Cryopreserved Human PBMC, CTL) were freeze-thawed and suspended in 50 U/ml Interleukin 2 (IL-2)/ RPMI/10% FBS so that the cell density was 2×10$^6$ cells/mL, and cultured at 37° C. for 4 days in a 5% CO$_2$ incubator. After 4 days, cells were harvested and washed twice with RPMI/10% FBS and then seeded at 100 µL into each well of a 96-well U-bottomed plate (8×10$^5$ cells/well, or 5×10$^5$ cells/well), and 25 µL of a KLH-G1m solution adjusted with RPMI/10% FBS to 8 mg/ml was added to each well. Then, 25 µL of each antibody solution prepared to each concentration (0, 2.4, 8, 24, and 80 µg/mL, or 0, 0.8, 8, 80, and 800 µg/mL) in RPMI/10% FBS was added to each well of the 96-well U-bottomed plate. In addition, 50 µL of an ATP solution adjusted to 0 or 400 µM in RPMI/10% FBS was added, the mixture was suspended well, and then left to stand at 37° C. for 6 hours in a CO$_2$ incubator (5 µL of ATP solution adjusted to 0 or 4000 µM was added every 2 hours twice in total). After 6 hours, PBMCs were harvested, washed twice with auto MACS Rinsing Solution (Miltenyi), reacted with the following antibodies, and the fractions of immune cells present was analyzed by FACS analysis: reagent for determining viability (Biolegend, Zombie Aqua), anti-CD3 antibody (BD, clone: UCHT1), anti-CD4 antibody (BD, clone: RPA-T4), anti-CD8 antibody (BD, clone: SK1), anti-CD45RA antibody (Biolegend, clone: HI100), anti-CD25 antibody (BD, clone: 2A3), anti-CD16 antibody (Biolegend, clone: 3G8), anti-CD56 antibody (Biolegend, clone: HCD56), anti-CTLA4 antibody (Biolegend, clone: BNI3). FACS analysis was performed by BD LSR Fortessa X-20 (BD). The ratio of CTLA4-positive regulatory T cells in viable cells at each antibody concentration was calculated, and the relative value, with the value at an antibody concentration of 0 taken as 100%, was defined as the survival rate (%) of CTLA4-positive regulatory T cells, and this was used as an index when evaluating the cytotoxic activity of each antibody. The obtained results are shown in FIG. 50 (SW1389-ART5+ACT1), FIG. 51 (SW1389-ART6+ACT1), FIG. 52 (SW1610-ART5+ACT1) and FIG. 53 (SW1610-ART6+ACT1).

From these results, it was confirmed that the cytotoxic activity of anti-CTLA4 switch antibodies with an altered Fc against CTLA4-positive regulatory T cells differed between the presence and absence of ATP, and that there was an ATP-dependent cytotoxic activity against CTLA4-positive regulatory T cells.

[Reference Example 7] Production of Fc Region Variants with Enhanced FcγR-Binding Ability Although Fc variants for enhancing cytotoxic effector functions ADCC and ADCP were previously reported, variants with symmetrically engineered CH2 domains and low-fucose antibodies made by sugar chain modifications all still had room for further enhancement of FcγR binding. In addition, although the variants with asymmetrically engineered CH2 domains described in WO2013002362 and WO2014104165 had greatly enhanced FcγR-binding ability compared to symmetrically-engineered Fc region variants, they had room for further improvement. Specifically, the Fc region variant Kn125/H1076 described in WO2013002362 and WO2014104165 (abbreviated name herein: ART1) had a strongly enhanced binding ability to FcγRIIIa, but its FcγRIIa-binding ability was enhanced only a few times compared to IgG1, so further enhancement seemed necessary to exhibit strong ADCP activity. Kn120/H1068 (abbreviated name herein: ART2) had enhanced binding to both FcγRIIa and FcγRIIIa and was expected to show strong ADCC and ADCP activity. However, its binding ability to inhibitory FcγRIIb was also enhanced, and therefore its A/I ratio, an index for exertion of excellent effector functions, was low. Thus, the existing methods have not achieved the most ideal profile, i.e. "antibody modification technology for stronger binding to activating FcγRIIa and FcγRIIIa and suppressed binding to inhibitory FcγRIIb". Accordingly, in the present invention, further combinations of modifications were studied, and the production of Fc region variants with a superior profile that would overcome the above-mentioned problems was studied.

Existing Fc region variants to be used as references for comparison were prepared as follows: First, antibody heavy chain gene H240-G1d (SEQ ID NO: 279) as described in WO2014104165, which has a heavy chain variable region against human Epiregulin and a heavy chain constant region sequence of human IgG1, was produced. G1d is a sequence obtained by deleting C-terminal Lys and Gly from the heavy chain constant region sequence of native human IgG1. Knobs-into-holes modifications (*Nat. Biotechnol.,* 1998, 16, 677), which are modifications for promoting heterodimerization, were introduced into the CH3 domain of H240-G1d, and modifications for enhancing FcγR binding were asymmetrically introduced into the CH2 domain, to produce Fc region variants to be used as references for comparison, ART1 and ART2. ART1, an Fc region variant with enhanced FcγRIIIa binding described in WO2013002362 and WO2014104165, was produced as follows: modifications for enhancing FcγR binding, L234Y/L235Q/G236W/S239M/H268D/D270E/S298A, were introduced into the CH2 domain of H240-G1d, and Y349C/T366W were introduced into the CH3 domain, to produce H240-Kn125 (SEQ ID NO: 280). In addition, D270E/K326D/A330M/K334E were introduced into the CH2 domain of H240-G1d, and D356C/T366S/L368A/Y407V were introduced into the CH3 domain, to produce H240-H1076 (SEQ ID NO: 281). Plasmids containing H240-Kn125, H240-H1076, and the gene for the light chain of anti-human Epiregulin antibody, L73-k0 (SEQ ID NO: 282), were mixed and introduced into the human embryonic kidney cell-derived Expi293 cell line (Invitrogen) by lipofection. After 4 days of culture, the supernatant was subjected to purification by a method known to those skilled in the art using rProtein A Sepharose™ Fast Flow (Amersham Biosciences) to obtain an Fc variant antibody against human Epiregulin (H240-Kn125/L73-k0//H240-H1076/L73-k0, abbreviated antibody name: EGL-ART1). The 280 nm absorbance of the purified antibody solution was measured using a spectrophotometer. The concentration of the purified antibody was calculated from the obtained measurement value using an extinction coefficient calculated by the PACE method (Protein Science 1995; 4:2411-2423).

Similarly, an Fc region variant with enhanced binding to both FcγRIIa and FcγRIIIa described in WO2013002362 and WO2014104165, EGL-ART2 (H240-Kn120/L73-k0//H240-H1068/L73-k0), was produced. Further, different combinations of FcγR binding-enhancing modifications, G236A, S239D, A330L, and I332E, were symmetrically introduced into the CH2 domain to produce known FcγR binding-enhanced antibodies, EGL-SDALIE (H240-Kn032/L73-k0//H240-H1032/L73-k0), EGL-GASDIE (H240-Kn037/L73-k0//H240-H1036/L73-k0), and EGL-GASDALIE (H240-GASDALIE/L73-k0). In addition to these, an afucosylated antibody, EGL-afucosyl, which reportedly has enhanced binding to FcγRIIIa (Glycobiol. Vol17 no 1 pp. 104-118 (2006) and such), was produced as a reference for comparison. In cells in which the expression of the fucose transporter gene is artificially suppressed on both homologous chromosomes, the function of the fucose transporter is inhibited. These cells can be used to obtain fucose-deficient antibodies (WO2006/067913 and such). Fucose-deficient antibodies can also be obtained by producing antibodies in cells forced to express beta 1,4-N-acetylglucosaminyltransferase III and Golgi alpha-mannosidase II (Biotechnol, Bioeng. (2006) 93 (5), 851-861). Using these methods known to those skilled in the art, EGL-afucosyl (H240-G1d/L73-k_glycomab) was produced.

In order to produce Fc region variants superior to these existing variants, the new Fc region variants shown in Table 47, namely, ART3, ART4, ART5, ART6, ART8, ART10, ART11, and ART12, were produced. These variants all had L234F, L235Q, G236W, S239M, H268D, D270E, and S298A introduced into one of the heavy chains, and D270E, S298A, K326D, and 334E introduced into the other heavy chain, and were produced by introducing, in addition to these core asymmetrical modifications, a combination of modifications for altering the FcγR binding. Specifically, for the chain to which L234F/L235Q/G236W/S239M/H268D/D270E/S298A were introduced, further introduction of K326D, A330M, and I332E was examined. For the chain to which D270E/S298A/K326D/K334E were introduced, further introduction of G236A, I332E, I332D, and A330M was examined. In addition to these FcγR binding-enhancing modifications, T250V and T307P, which are modifications for improving antibody stability as described in WO2013118858, were introduced into both chains of ART4, ART5, ART6, ART8, ART10, ART11, and ART12.

As used herein, the name of each heavy chain constant region corresponds to the SEQ ID NOs as follows: G1d (SEQ ID NO: 307), Kn125 (SEQ ID NO: 308), H1076 (SEQ ID NO: 309), k0 (SEQ ID NO: 310), Kn120 (SEQ ID NO: 311), H1068 (SEQ ID NO: 312), Kn443 (SEQ ID NO: 313), H1408 (SEQ ID NO: 314), Kn456 (SEQ ID NO: 315), H1446 (SEQ ID NO: 316), Kn462 (SEQ ID NO: 317), H1441 (SEQ ID NO: 318), Kn462 (SEQ ID NO: 319), H1445 (SEQ ID NO: 320), Kn461 (SEQ ID NO: 321), H1443 (SEQ ID NO: 322), Kn494 (SEQ ID NO: 323), H1514 (SEQ ID NO: 324), Kn49% (SEQ ID NO: 325), H1516 (SEQ ID NO: 326), Kn498 (SEQ ID NO: 327), H1518 (SEQ ID NO: 328), GASDALIE (SEQ ID NO: 329), Kn032 (SEQ ID NO: 330), H1032 (SEQ ID NO: 331), Kn037 (SEQ ID NO: 332), H1036 (SEQ ID NO: 333), G4d (SEQ ID NO: 334).

Produced Fc Region Variants and Introduced Modifications

TABLE 47

| Abbreviated name of antibody | Heavy chain name | SEQ ID NO: | Modifications introduced into CH2 domain of G1d | Modifications introduced into CH3 domain of G1d |
|---|---|---|---|---|
| EGL-G1d | H240-G1d | 1 | | |
| EGL-ART1 | H240-Kn125 | 2 | L234Y/L235Q/G236W/S239M/H268D/D270E/S298A | Y349C/T366W |
|  | H240-H1076 | 3 | D270E/K326D/A330M/K334E | D356C/T366S/L368A/Y407V |
| EGL-ART2 | H240-Kn120 | 5 | L234Y/L235Y/G236W/S239M/H268D/S298A/A327D | Y349C/T366W |
|  | H240-H1068 | 6 | D270E/K326D/A330K/K334E | D356C/T366S/L368A/Y407V |
| EGL-ART3 | H240-Kn443 | 7 | L234F/L235Q/G236W/S239M/H268D/D270E/S298A/K326D | Y349C/T366W |
|  | H240-H1408 | 8 | G236A/D270E/S298A/K326D/K334E | D356C/T366S/L368A/Y407V |
| EGL-ART4 | H240-Kn456 | 9 | L234F/L235Q/G236W/S239M/T250V/H268D/D270E/S298A/T307P/A330M/I332E | Y349C/T366W |
|  | H240-H1446 | 10 | G236A/T250V/D270E/S298A/T307P/K326D/A330M/I332E/K334E | D356C/T366S/L368A/Y407V |
| EGL-ART5 | H240-Kn462 | 11 | L234F/L235Q/G236W/S239M/T250V/H268D/D270E/S298A/T307P/K326D | Y349C/T366W |
|  | H240-H1441 | 12 | G236A/T250V/D270E/S298A/T307P/K326D/K334E | D356C/T366S/L368A/Y407V |

TABLE 47-continued

| Abbreviated name of antibody | Heavy chain name | SEQ ID NO: | Modifications introduced into CH2 domain of G1d | Modifications introduced into CH3 domain of G1d |
|---|---|---|---|---|
| EGL-ART6 | H240-Kn462 | 13 | L234F/L235Q/G236W/S239M/T250V/H268D/D270E/S298A/T307P/K326D | Y349C/T366W |
| | H240-Hl445 | 14 | G236A/T250V/D270E/S298A/T307P/K326D/A330K/I332D/K334E | D356C/T366S/L368A/Y407V |
| EGL-ART8 | H240-Kn461 | 15 | L234F/L235Q/G236W/S239M/T250V/H268D/D270E/S298A/T307P/K326D/I332E | Y349C/T366W |
| | H240-Hl443 | 16 | G236A/T250V/D270E/S298A/T307P/K326D/I332E/K334E | D356C/T366S/L368A/Y407V |
| EGL-ART10 | H240-Kn494 | 17 | L234F/L235Q/G236W/S239M/T250V/H268D/D270E/S298A/T307P/I332E | Y349C/T366W |
| | H240-Hl514 | 18 | T250V/D270E/S298A/T307P/K326D/I332E/K334E | D356C/T366S/L368A/Y407V |
| EGL-ART11 | H240-Kn496 | 19 | L234F/L235Q/G236W/S239M/T250V/H268D/D270E/S298A/T307P | Y349C/T366W |
| | H240-Hl516 | 20 | T250V/D270E/S298A/T307P/K326D/K334E | D356C/T366S/L368A/Y407V |
| EGL-ART12 | H240-Kn498 | 21 | L234F/L235Q/G236W/S239M/T250V/H268D/D270E/S298A/T307P/A330M | Y349C/T366W |
| | H240-Hl518 | 22 | T250V/D270E/S298A/T307P/K326D/A330M/K334E | D356C/T366S/L368A/Y407V |
| EGL-GASDALIE | H240-GASDALIE | 23 | G236A/S239D/A330L/I332E | |
| EGL-SDALIE | H240-Kn032 | 24 | S239D/A330L/I332E | Y349G/T366W |
| | H240-Hl032 | 25 | S239D/A330L/I332E | D356C/T366S/L368A/Y407V |
| EGL-GASDIE | H240-Kn037 | 26 | G236A/S239D/I332E | Y349C/T366W |
| | H240-Hl036 | 27 | G236A/S239D/I332E | D356C/T366S/L368A/Y407V |
| EGL-afucosyl | H240-G1d | 1 | | |

Reference Example 8

Evaluation of FcγR Binding of Fc Region Variants

The extracellular domains of FcγRs were produced by the method described in WO2014104165. The interaction between the produced antibodies and human FcγRs was analyzed using Biacore 8K+ by the method below. For the running buffer, 50 mM Na-Phosphate, 150 mM NaCl, and 0.05% Tween20 (pH 7.4) was used, and measurement was performed at 25° C. The sensor chip used was a Series S SA chip (GE Healthcare) onto which CaptureSelect Human Fab-kappa Kinetics Biotin Conjugate (Thermo Fisher Scientific) was immobilized. An antibody of interest was captured onto this chip, and each FcγR diluted with the running buffer was allowed to interact with it. The chip was regenerated using 10 mM Glycine-HCl (pH 1.5), and repeatedly used to capture antibodies and perform measurement. The dissociation constants KD (mol/L) of each antibody for FcγRs were calculated using Biacore Insight Evaluation Software, with a steady state affinity model for the dissociation constant for FcγRIIb and a 1:1 Langmuir binding model for the dissociation constants for the other FcγRs (Table 48).

Measurement of Binding Between Produced Variants and Human FcγRs

TABLE 48

| Abbreviated name of constant region | Antibody name | $K_D$ (M) for hFcγRs | | | | | | Relative value to $K_D$ between G1d and hFcgRs |
|---|---|---|---|---|---|---|---|---|
| | | hFcγR Ia | hFcγR IIa H | hFcγR IIa R | hFcγR IIb | hFcγR IIIa F | hFcγR IIIa V | hFcγR Ia |
| G1d | H240-G1d/L73-k0 | 9.01E−11 | 1.12E−06 | 1.66E−06 | 1.01E−05 | 2.96E−06 | 3.58E−07 | 1.0 |
| ART1 | H240-Kn125/L73-k0// H240-Hl076/L73-k0 | 3.02E−11 | 2.64E−07 | 1.01E−06 | 1.25E−05 | 2.53E−09 | 1.11E−09 | 3.0 |
| ART2 | H240-Kn120/L73-k0// H240-Hl068/L73-k0 | 2.64E−11 | 7.64E−08 | 3.38E−08 | 4.40E−07 | 6.43E−09 | 1.67E−09 | 3.4 |
| ART3 | H240-Kn443/L73-k0// H240-Hl408/L73-k0 | 1.72E−10 | 3.50E−08 | 1.21E−07 | 6.33E−06 | 1.60E−08 | 3.16E−09 | 0.5 |
| ART4 | H240-Kn456/L73-k0// H240-Hl446/L73-k0 | 3.05E−11 | 1.79E−07 | 5.18E−07 | 1.17E−05 | 1.17E−09 | 7.75E−10 | 2.9 |
| ART5 | H240-Kn462/L73-k0// H240-Hl441/L73-k0 | 1.69E−10 | 3.32E−08 | 1.60E−07 | 7.96E−06 | 2.00E−08 | 3.86E−09 | 0.5 |
| ART6 | H240-Kn462/L73-k0// H240-Hl445/L73-k0 | 7.37E−11 | 9.52E−09 | 6.89E−08 | 2.92E−06 | 3.00E−09 | 1.11E−09 | 1.2 |
| ART8 | H240-Kn461/L73-k0// H240-Hl443/L73-k0 | 2.80E−11 | 7.49E−08 | 1.26E−07 | 3.53E−06 | 1.50E−09 | 5.10E−10 | 3.2 |
| ART10 | H240-Kn494/L73-k0// H240-Hl514/L73-k0 | 2.67E−11 | 4.20E−07 | 1.10E−06 | 7.25E−06 | 2.29E−09 | 6.34E−10 | 3.4 |
| ART11 | H240-Kn496/L73-k0// H240-Hl516/L73-k0 | 3.81E−11 | 2.31E−07 | 1.27E−06 | 1.46E−05 | 2.10E−08 | 3.67E−09 | 2.4 |
| ART12 | H240-Kn498/L73-k0// H240-Hl518/L73-k0 | 2.61E−11 | 3.66E−07 | 1.72E−06 | 2.21E−05 | 5.12E−09 | 2.27E−09 | 3.4 |
| GASDALIE | H240-GASDALIE/L73-k0 | 4.23E−12 | 1.62E−07 | 1.61E−07 | 2.67E−06 | 2.98E−08 | 1.52E−08 | 21.3 |
| SDALIE | H240-Kn032/L73-k0// H240-Hl032/L73-k0 | 1.66E−12 | 1.18E−06 | 9.35E−07 | 2.59E−06 | 2.62E−08 | 9.73E−09 | 54.3 |

TABLE 48-continued

| | | | | | | | | |
|---|---|---|---|---|---|---|---|---|
| GASDIE | H240-Kn037/L73-k0//<br>H240-Hl036/L73-k0 | 1.45E−11 | 6.86E−08 | 6.70E−08 | 1.25E−06 | 6.61E−08 | 2.38E−08 | 6.2 |
| Afucosyl | H240-G1d/L73-<br>k_glycomab | 6.51E−11 | 9.99E−07 | 9.46E−07 | 5.65E−06 | 1.23E−07 | 1.90E−08 | 1.4 |

| Abbreviated name of constant region | Antibody name | Relative value to $K_D$ between G1d and hFcgRs | | | | | A/I ratio for ($K_D$ FcγRIIb divided by $K_D$ for each FcγR) | | | |
|---|---|---|---|---|---|---|---|---|---|---|
| | | hFcγR IIa H | hFcγR IIa R | hFcγR IIb | hFcγR IIIa F | hFcγR IIIa V | hFcγR IIa H | hFcγR IIa R | hFcγR IIIa F | hFcγR IIIa V |
| G1d | H240-G1d/L73-k0 | 1.0 | 1.0 | 1.0 | 1.0 | 1.0 | 8.9 | 6.1 | 3.4 | 28.1 |
| ART1 | H240-Kn125/L73-k0//<br>H240-Hl076/L73-k0 | 4.3 | 1.6 | 0.8 | 1170.2 | 322.8 | 47.4 | 12.4 | 4947.2 | 11261.3 |
| ART2 | H240-Kn120/L73-k0//<br>H240-Hl068/L73-k0 | 14.7 | 49.0 | 22.8 | 459.6 | 214.6 | 5.8 | 13.0 | 68.4 | 263.7 |
| ART3 | H240-Kn443/L73-k0//<br>H240-Hl408/L73-k0 | 32.1 | 13.7 | 1.6 | 185.2 | 113.5 | 180.7 | 52.4 | 396.1 | 2003.7 |
| ART4 | H240-Kn456/L73-k0//<br>H240-Hl446/L73-k0 | 6.3 | 3.2 | 0.9 | 2519.9 | 462.2 | 65.2 | 22.5 | 9943.2 | 15047.3 |
| ART5 | H240-Kn462/L73-k0//<br>H240-Hl441/L73-k0 | 33.9 | 10.4 | 1.3 | 148.1 | 92.9 | 240.1 | 49.9 | 398.8 | 2064.8 |
| ART6 | H240-Kn462/L73-k0//<br>H240-Hl445/L73-k0 | 118.0 | 24.1 | 3.4 | 986.7 | 321.9 | 307.0 | 42.4 | 975.5 | 2625.7 |
| ART8 | H240-Kn461/L73-k0//<br>H240-Hl443/L73-k0 | 15.0 | 13.2 | 2.8 | 1966.7 | 694.9 | 47.2 | 28.1 | 2350.3 | 6852.0 |
| ART10 | H240-Kn494/L73-k0//<br>H240-Hl514/L73-k0 | 2.7 | 1.5 | 1.4 | 1289.2 | 565.5 | 17.3 | 6.6 | 3159.9 | 11436.1 |
| ART11 | H240-Kn496/L73-k0//<br>H240-Hl516/L73-k0 | 4.9 | 1.3 | 0.7 | 140.6 | 97.5 | 63.3 | 11.5 | 694.1 | 3974.6 |
| ART12 | H240-Kn498/L73-k0//<br>H240-Hl518/L73-k0 | 3.1 | 1.0 | 0.5 | 577.5 | 157.9 | 60.3 | 12.8 | 4309.9 | 9721.0 |
| GASDALIE | H240-GASDALIE/L73-k0 | 6.9 | 10.3 | 3.8 | 99.1 | 23.6 | 16.5 | 16.5 | 89.3 | 175.7 |
| SDALIE | H240-Kn032/L73-k0//<br>H240-Hl032/L73-k0 | 1.0 | 1.8 | 3.9 | 112.7 | 36.8 | 2.2 | 2.8 | 98.7 | 266.1 |
| GASDIE | H240-Kn037/L73-k0//<br>H240-Hl036/L73-k0 | 16.4 | 24.7 | 8.0 | 44.7 | 15.1 | 18.2 | 18.6 | 18.9 | 52.6 |
| Afucosyl | H240-G1d/L73-<br>k_glycomab | 1.1 | 1.8 | 1.8 | 24.0 | 18.9 | 5.7 | 6.0 | 46.0 | 298.1 |

In the table, the "Relative value to KD between G1d and hFcγRs" is a value obtained by dividing the KD value of G1d for each FcγR by the KD value of each antibody for each FcγR, indicating how much each antibody was enhanced as compared to G1d. The "A/I ratio" is a value obtained by dividing the KD of each antibody for FcγRIIb by the KD for each FcγR, indicating how much the binding to activating FcγRs was selectively enhanced over the binding to inhibitory FcγR.

ART3, ART4, ART5, ART6, ART8, ART10, ART11, and ART12 produced in the present invention were all enhanced as compared to G1d for FcγRIIIaF and FcγRIIIaV. These variants were also more enhanced than the existing symmetrically-modified FcγR-enhanced antibodies GASDALIE, SDALIE, GASDIE, and Afucosyl antibody for both FcγRIIIaF and FcγRIIIaV. Moreover, the FcγRIIIaF binding of ART4 (2519.9 times), ART6 (986.7 times), ART8 (1966.7 times), ART10 (1289.2 times), and ART12 (577.5 times) was more enhanced than that of ART2 (459.6 times), which is described in WO2014104165. Furthermore, the FcγRIIIaF binding of ART4, ART8, and ART10 was more enhanced even when compared to ART1 (1170.2 times), which binds to FcγRIIIaF more strongly than ART2. Similarly, for FcγRIIIaV, the binding of ART4 (462.2 times), ART6 (321.9 times), ART8 (694.9 times), and ART10 (565.5 times) was more enhanced than that of ART2 (214.6 times), and the binding of ART4, ART8, and ART10 was more enhanced even when compared to ART1 (322.8 times). The FcγRIIIaV binding of ART6 was comparable to that of ART1.

ART3 (32.1 times), ART4 (6.3 times), ART5 (33.9 times), ART6 (118.0 times), ART8 (15.0 times), ART10 (2.7 times), ART11 (4.9 times), and ART12 (3.1 times) were all enhanced as compared to G1d for FcγRIIaH. In particular, ART3, ART5, ART6, and ART8 were more enhanced even when compared to ART2 (14.7 times), an FcγRIIa-enhanced antibody with asymmetrically modified CH2 domains as described in WO2014104165. Moreover, ART3, ART5, and ART6 were more enhanced even when compared to the existing symmetrically-modified FcγRIIa-enhanced antibody GASDIE (16.4 times), and therefore are expected to show stronger ADCP activity than any existing variants. For the binding to FcγRIIaR, all of ART3 (13.7 times), ART4 (3.2 times), ART5 (10.4 times), ART6 (24.1 times), ART8 (13.2 times), ART10 (1.5 times), and ART11 (1.3 times) were enhanced as compared to G1d, but the existing variants GASDIE (24.7 times) and ART2 (49.0 times) were more enhanced than these variants. However, what should be noted here is selectivity for activating FcγRs. As the inhibitory receptor FcγRIIb induces intracellular signals that suppress immune responses in contrast to activating FcγRs, it is expected to inhibit signals from activating FcγRs. In fact, it has been reported that the anti-tumor effects of antibodies are increased in FcγRIIb knockout mice (Nature Medicine 2000, 6, 443-436). In addition, a correlation was observed between the anti-tumor effects and the ratios of binding to activating FcγR and inhibitory FcγR (A/I ratio) in each subclass of mouse IgG (Science 2005, 310, 1510-1512). Thus, in order to exert stronger effector functions, an antibody with enhanced binding to activating FcγRs and reduced binding to FcγRIIb may be necessary. However, the high sequence homology of FcγRIIaR with FcγRIIb makes it difficult to confer selectivity, and indeed it is hard to say that the variants previously reported have excellent selectivity. It was shown that the new variants produced in the present invention, ART10 (A/I ratio: 6.6), ART11 (A/I ratio: 11.5), ART12 (A/I ratio: 12.8), ART4 (A/I ratio: 22.5), ART8 (A/I ratio: 28.1), ART6 (A/I ratio: 42.4), ART5 (A/I ratio: 49.9), and ART3 (A/I ratio: 52.4), were all superior to G1d (A/I ratio: 6.1) in terms of the A/I ratio for FcγRIIaR, and among them, ART4, ART8, ART6, ART5, and ART3 were superior to ART2 (A/I ratio: 13.0) and GASDIE (A/I ratio: 18.6). Similarly, in terms of the A/I ratio for FcγRIIaH, ART10 (A/I ratio: 17.3), ART8 (A/I ratio: 47.2), ART12 (A/I ratio: 60.3), ART11 (A/I ratio: 63.3), ART4 (A/I ratio: 65.2), ART3 (A/I ratio: 180.7), ART5 (A/I ratio: 240.1), and ART6 (A/I ratio: 307.0) were superior to G1d (A/I ratio: 8.9), and among them, ART8, ART12, ART11, ART4, ART3, ART5, and ART6 showed better A/I ratios than ART2 (A/I ratio: 5.8) and GASDIE (A/I ratio: 18.2). From the above results, it can be said that ART4, ART8, ART3, ART5, and ART6 are antibodies that have better A/I ratios than the existing antibodies enhanced for FcγRIIaR. In addition, it can be said that ART3, ART5, and ART6 are antibodies that have better binding ability and A/I ratios than the existing antibodies enhanced for FcγRIIaH.

For FcγRIIIaF, the A/I ratios of ART3 (A/I ratio: 396.1), ART5 (A/I ratio: 398.8), ART11 (A/I ratio: 694.1), ART6 (A/I ratio: 975.5), ART8 (A/I ratio: 2350.3), ART10 (A/I ratio: 3159.9), ART12 (A/I ratio: 4309.9), and ART4 (A/I ratio: 9943.2) were all superior to that of G1d (A/I ratio: 3.4). Among them, ART4 showed a better A/I ratio than ART1 (A/I ratio: 4947.2), an FcγRIIIa specific enhanced variant described in WO2014104165. Similarly, for FcγRIIIaV, the A/I ratios of ART3 (A/I ratio: 2003.7), ART5 (A/I ratio: 2064.8), ART6 (A/I ratio: 2625.7), ART11 (A/I ratio: 3974.6), ART8 (A/I ratio: 6852.0), ART12 (A/I ratio: 9721.0), ART10 (A/I ratio: 11436.1), and ART4 (A/I ratio: 15047.3) were all better than those of G1d (A/I ratio: 28.1) and the existing enhance variant Afucosyl (A/I ratio: 298.1). Among them, ART4 and ART10 showed better A/I ratios than ART1 (A/I ratio: 11261.3), an FcγRIIIa specific enhanced variant described in WO2014104165. From the above results, it can be said that ART4 is an antibody that has more excellent binding ability and A/I ratios for both FcγRIIIaF and FcγRIIIaV as compared to the existing enhanced antibody ART1.

Reference Example 9

Evaluation of Antibodies Having Modified Fc Regions by ADCC Reporter Bioassay
(9-1) Production of Human Epiregulin-Expressing Cells (Hepa1-6/hEREG)

Murine hepatoma cell line Hepa1-6 was purchased from ATCC. A human EREG (hEREG) gene was introduced into the cells by transfection, and constitutively expressing clones were selected. The hEREG gene is selected using Zeocin. Hepa1-6/hEREG cells were maintained and passaged in D-MEM (high glucose) medium (SIGMA) containing 10% FBS (SIGMA) and 400 μg/mL Zeocin.
(9-2) Evaluation by ADCC Reporter Bioassay For measurement of in vitro ADCC activity, hFcγRIIIaV ADCC Reporter Bioassay, Effector cells, Propagation Model (Promega) was used. As target cells, 10 μL of Hepa1-6/hEREG cells adjusted to 5×10$^5$ cells/mL with the culture medium was added to each well of a 384-well plate. The medium used was Assay Buffer (96% RPMI, 4% FBS). Next, the antibodies produced in Reference Example 7 and EGL-G4d (heavy chain SEQ ID NO: 306, light chain SEQ ID NO: 282) as a negative control, which has the sequence of human IgG4, were each diluted with the assay buffer to give 11 serial dilutions at a common ratio of 10 starting from the final concentration of 1 μg/mL, and then 10 μL each was added. Finally, as an effector cell solution, 10 μL of hFcγRIIIaV-expressing Jurkat cells adjusted to 3×10$^6$ cells/mL with the medium was added, and 30 μL in total was mixed. The mixture was then allowed to stand in a 5% $CO_2$ incubator at 37° C. overnight. The plate was then allowed to stand at room temperature for 15 minutes, and 30 μL of a Bio-Glo reagent was added to each well. For the Bio-Glo reagent, Bio-Glo Luciferase Assay System (Buffer and Substrate) was used. Subsequently, the luminescence of each well was measured using a plate reader.

A fold induction value was determined by dividing the luminescence value of each well by the luminescence value of the well with no antibody added, and used as an index to evaluate the ADCC of each antibody. The obtained results are shown in FIG. 54. The EC 50 value of each sample was calculated using JMP 11.2.1 (SAS Institute Inc.), and is shown in Table 49.
EC50 Value of hFcγRIIIaV-Mediated Reporter Gene Induction Activity of Each Modified Fc-Containing Antibody

TABLE 49

| Abbreviated name of antibody | EC50 value (μg/mL) |
| --- | --- |
| EGL-G1d | 4.63E−02 |
| EGL-ART1 | 7.16E−04 |
| EGL-ART2 | 1.35E−03 |
| EGL-ART3 | 1.53E−03 |
| EGL-ART4 | 7.89E−04 |
| EGL-ART5 | 1.67E−03 |
| EGL-ART6 | 1.50E−03 |
| EGL-ART8 | 1.07E−03 |
| EGL-ART10 | 1.07E−04 |
| EGL-ART11 | 4.13E−04 |
| EGL-ART12 | 3.04E−04 |
| EGL-GASDALIE | 2.08E−03 |
| EGL-SDALIE | 1.78E−03 |
| EGL-GASDIE | 3.70E−03 |
| EGL-G4d | N/A |
| EGL-afucosyl | 5.16E−03 |

These results showed that the antibodies with modified Fc produced this time exhibit a stronger reporter gene induction activity against Hepa1-6/hEREG cells than the wildtype human IgG1 constant region. The results of Table 49 also showed that all these variants exhibited the activity at lower concentrations than variants with symmetrically engineered CH2 domains and low-fucose antibodies produced by sugar chain modification. Among the variants produced this time, ART3, ART4, ART5, ART6, ART8, ART10, ART11, and ART12 were shown to have the activity at about the same or lower concentration than ART2. In particular, ART4, ART10, ART11, and ART12 exhibited the activity at lower concentrations even when compared to ART1, which has more enhanced hFcγRIIIaV binding than ART2.

Reference Example 10

Evaluation of Antibodies Having Modified Fc Regions by ADCP Reporter Bioassay

For measurement of in vitro ADCP activity, hFcγRIIaH ADCP Reporter Bioassay, Core Kit (Promega) was used. As target cells, 10 μL of Hepa1-6/hEREG cells adjusted to 1×10$^6$ cells/mL with the culture medium was added to each well of a 384-well plate. Assay Buffer (96% RPMI, 4% FBS) was used as the culture medium. Next, the antibodies produced in Reference Example 7 were each diluted with the assay buffer to final concentrations of 0, 0.001, 0.01, 0.1, 1, and 10 μg/mL, and then 10 μL each was added. Finally, as an effector cell solution, 10 μL of hFcγRIIaH-expressing Jurkat cells attached to the kit was added, and 30 μL in total was mixed. The mixture was then allowed to stand in a 5% $CO_2$ incubator at 37° C. for 6 hours. The cell density of the hFcγRIIaH-expressing Jurkat cells was $9.68 \times 10^5$ cells/mL. The plate was then allowed to stand at room temperature for 15 minutes, and 30 μL of a Bio-Glo reagent was added to each well. For the Bio-Glo reagent, Bio-Glo Luciferase Assay System (Buffer and Substrate) was used. Subsequently, the luminescence of each well was measured using a plate reader. A fold induction value was determined by dividing the luminescence value of each well by the luminescence value of the well with no antibody added, and used as an index to evaluate the ADCP of each antibody. The obtained results are shown in FIG. 55. The EC 50 value of each sample was calculated using JMP 11.2.1 (SAS Institute Inc.), and is shown in Table 50.

EC50 Value of hFcγRIIaH-Mediated Reporter Gene Induction Activity of Each Modified Fc-Containing Antibody

TABLE 50

| Abbreviated name of antibody | EC50 value (μg/mL) |
|---|---|
| EGL-G1d | N/A |
| EGL-ART1 | 3.53E−02 |
| EGL-ART2 | 2.18E−02 |
| EGL-ART3 | 1.58E−02 |
| EGL-ART4 | 4.32E−02 |
| EGL-ART5 | 2.45E−02 |
| EGL-ART6 | 1.92E−02 |
| EGL-ART8 | 1.71E−02 |
| EGL-ART10 | 4.19E−02 |
| EGL-ART11 | 3.67E−02 |
| EGL-ART12 | 8.50E−02 |
| EGL-GASDALIE | 3.24E−02 |
| EGL-SDALIE | N/A |
| EGL-GASDIE | 1.49E−02 |
| EGL-G4d | N/A |
| EGL-afucosyl | N/A |

These results showed that the antibodies with modified Fc produced this time exhibit a stronger reporter gene induction activity against Hepa1-6/hEREG cells than the wildtype human IgG1 constant region. The results of Table 50 also showed that they exhibited the activity at lower concentrations than variants with symmetrically engineered CH2 domains and low-fucose antibodies produced by sugar chain modification. Moreover, among the variants produced this time, ART2, ART3, ART5, ART6, and ART8 were shown to have the activity at lower concentration than ART1. In particular, ART3, ART6, and ART8 exhibited the activity at lower concentrations even when compared to ART2, which has more enhanced hFcγRIIaH binding.

Reference Example 11

Evaluation of the Antitumor Effect of Antibodies Having Modified Fc Regions in a Syngeneic Tumor Cell Transplant Model Using Human FcγR Transgenic Mice (11-1) Cell Line The Hepa1-6/hEREG cells produced in Reference Example 9-1 were maintained and passaged in D-MEM (high glucose) medium (SIGMA) containing 10% FBS (SIGMA) and 400 μg/mL Zeocin.

(11-2) Production of a Syngeneic Tumor Line Transplant Mouse Model

For the efficacy test, human FcγR transgenic mice (Proc Natl Acad Sci USA. 2012 Apr. 17; 109 (16): 6181-6186) were used. Male mice at the age of 16 weeks were intraperitoneally given an anti-asialo GM1 antibody (aGM1, WAKO) at 100 μL/head in order to improve the cell engraftment rate. On the following day of aGM1 administration, a cell solution in which Hepa1-6/hEREG cells and matrigel (CORNING) were mixed at 1:1 was subcutaneously given to transplant $1 \times 10^7$ cells. The model was determined to be established when the average volume of the grafted tumor reached approximately 300 $mm^3$ to 500 $mm^3$.

The volume of the grafted tumor was calculated with the following formula:

Tumor volume=long diameter×short diameter×short diameter/2

(11-3) Preparation of Agents to be Administered

EGL-ART6 produced in the present invention was expected to have the most potent antitumor activity in view of the A/I ratio results in Reference Example 8 and the strength of the reporter gene induction activities in Reference Examples 9 and 10. Thus, the agents to be administered to the Hepa1-6/hEREG cell transplant model were the anti-hEREG control antibody (EGL-G1d) and the anti-hEREG antibodies having Fc with enhanced FcγR binding (EGL-afucosyl and EGL-ART6) prepared by the same method as in Reference Example 7, which were each prepared at 1 mg/mL using His buffer (150 mM NaCl, 20 mM His-HCl buffer pH6.0).

(11-4) Agent Administration in Antitumor Effect Measurement

After 7 days of transplantation, EGL-G1d, EGL-afucosyl, and EGL-ART6 were administered at 10 mg/kg via the tail vein.

Details on the agent treatment in antitumor effect measurement are shown in Table 51.

Measurement of Antitumor Effect in Hepa1-6/hEREG Cell Transplant Model

TABLE 51

| Group | Heads | Agent | Dose | Administration route | Administration date |
|---|---|---|---|---|---|
| 1 | 5 | His buffer | — | Tail vein | 7th day after transplantation |
| 2 | 5 | EGL-G1d | 10 mg/kg | | |
| 3 | 5 | EGL-afucosyl | 10 mg/kg | | |
| 4 | 5 | EGL-ART6 | 10 mg/kg | | |

(11-5) Evaluation of Antitumor Effect

Antitumor effect was evaluated by the tumor volume calculated using the formula shown in (11-2).

TGI (tumor growth inhibition) values were calculated using the following formula:

> TGI=(1−(Average tumor volume of a group of interest at the time of measurement−Average tumor volume before antibody administration)/(Average tumor volume of the control group at the time of measurement−Average tumor volume before antibody administration))×100

As a result, both FcγR binding-enhanced antibodies EGL-afucosyl and EGL-ART6, administered at 10 mg/kg, showed an efficacy of TGI=80 or higher on day 19 after administration. On the other hand, the control antibody EGL-G1d showed TGI=31 (FIG. 56). This confirmed that the in vivo antitumor effect of EGL-ART6 produced in the present invention is also enhanced as compared to EGL-afucosyl as expected.

Reference Example 12

Evaluation of C1q-Binding Activity of Antibodies Having Modified Fc Regions

While the CDC activity of antibodies has been reported to contribute to antitumor effects (Nat. Immunol., 2017, 18, 889), it is known to cause side effects derived from CDC activity, as represented by infusion-related reaction (J. Immunol. 2008, 180, 2294-2298 and Br. J. Haematol. 2001, 115, 807-811). Therefore, even when developing antibody pharmaceuticals with enhanced ADCC activity and ADCP activity, it is preferred that the degree of CDC activity can be chosen depending on the target disease. The interaction between complement and Fc is mediated by C1q. According to reports of analyzing the interaction between C1q and Fc (Science, 2018, 359, 794-797 and Molecular Immunology 2012, 51, 66-72), the FcγR and C1q interaction sites on the Fc region appear to overlap in part. These articles report that the residues at EU numbering positions 329, 330, and 331 on Fc are important for interaction with C1q, and in addition, the residues at EU numbering positions 268, 270, and 298 also contribute to the binding with C1q. These positions and surrounding residues are modified in the present invention to enhance the FcγR binding. Therefore, the produced Fc region variants are likely to also have enhanced or reduced binding to C1q, and hence it may be possible to control CDC activity in developing antibody pharmaceuticals. Accordingly, the binding of the produced Fc region variants to C1q was evaluated.

The anti-human Epiregulin antibodies produced in Reference Examples 7 and 9 were subjected to ELISA. In addition, the buffers shown in Table 52 were prepared as necessary. The antigen used was a human C1q protein (hC1q).

Composition of Buffers Used in Human C1q ELISA

TABLE 52

| Buffer | Composition |
| --- | --- |
| Blocking/dilution buffer: | TBS, 0.1% Tween20, 0.5% BSA, 1x Block ace powder |
| Wash Buffer | PBST, pH 7. 4 |
| Stop Buffer | 0.5 mol/L sulfuric acid |

First, a 96-well maxisorp plate (Thermo fisher) was coated at 4° C. overnight with 50 μL of solutions containing each antibody prepared at 30, 10, 3, 1, 0.3, 0.1, and 0.03 μg/mL in PBS. Each well of the plate was washed with Wash buffer to remove the antibody not bound to the plate, and then the wells were blocked with 200 μL of Blocking/dilution Buffer at room temperature for 2 hours or longer. After the Blocking/dilution Buffer was removed from each well, hC1q (Calbiochem) prepared such that the final concentration was 3 μg/mL in Blocking/dilution Buffer was added at 50 μL per well. The plate was then allowed to stand at room temperature for 1 hour to allow hC1q to bind to the antibody within each well. After washing with Wash Buffer, 50 μL of an HRP-conjugated anti-hC1q antibody (AbDSerotec) diluted with Blocking/dilution Buffer was added to each well, and the plate was incubated while standing for 1 hour. After washing with Wash Buffer, TMB single solution (Invitrogen) was added. The color development reaction of the solution in each well was stopped by addition of Stop Buffer, and then the developed color was measured by absorbance at 450 nm and 690 nm. The buffers used were those containing the composition shown in Table 52. The measured results are shown in FIG. 57 and FIG. 58.

As shown in FIG. 57 and FIG. 58, among the variants evaluated, ART3, ART5, and ART11 had an enhanced C1q binding ability as compared to G1d. The binding ability of Afucosyl and ART8 was comparable to that of G1d. In addition, the C1q binding of ART1, ART2, ART4, ART6, ART10, ART12, GASDALIE, SDALIE, and GASDIE was reduced as compared to that of G1d. Of these, the C1q binding ability of ART1, ART2, ART4, ART6, ART12, GASDALIE, SDALIE, and GASDIE was reduced to the same level as that of G4d, which has a human IgG4 sequence. As human IgG4 is considered to have little CDC activity (J. Immunol. Methods 2005, 306, 151-160), these variants whose binding to C1q is reduced to the same level as that of G4d would have little CDC activity like IgG4. The common amino acid modifications shared by these variants with greatly reduced C1q binding include a modification at Ala330 or a modification at Ile332. These regions, in particular Ala330, are very important regions for interaction with C1q. This gives the inference that it is the modification introduced into this site that greatly reduced the binding with C1q. On the other hand, ART3, ART5, and ART11, which had enhanced C1q binding as compared to G1d, did not have a modification introduced at position 330 or position 332, suggesting that the enhanced binding was due to the effect of the S298A modification or a modification at position 326, which is believed to improve the binding to C1q (Science, 2018, 359, 794-797).

Although the aforementioned inventions have been described in detail with reference to illustrations and examples for the purpose of assisting a clear understanding, the description and examples herein should not be construed as limiting the scope of the present invention. Disclosures of all patent and scientific literatures cited throughout herein are expressly incorporated herein by reference.

INDUSTRIAL APPLICABILITY

The anti-CTLA-4 antibodies of the present disclosure, and methods using them can be utilized in the development, production, provision, use and such of pharmaceuticals with few side effects since the antibodies of the present disclosure, while having immune cell activating activity, cytotoxic activity, and/or antitumor activity, have a low effect on non-tumor tissues such as normal tissues. In addition, polypeptides containing the variant Fc region of the present disclosure and the methods for producing and using the same can be utilized in the development, production, provision, use and such of pharmaceuticals which have high ADCC/ADCP activity and/or antitumor effect due to strong binding to activating FcγRIIa and FcγRIIIa and reduced binding to inhibitory FcγRIIb.

SEQUENCE LISTING (386 sequences)

SEQ ID NO: 1 - protein, 188 aa, Artificial Sequence
  CTLA4
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFHHHHHHGGGGSGLNDIFEAQKIEWHE

SEQ ID NO: 2 - DNA, 20 bp, Artificial Sequence
  primer
cgcaacgcaattaatgtgag

SEQ ID NO: 3 - DNA, 21 bp, Artificial Sequence
  primer
tgagttccacgacaccgtcac

SEQ ID NO: 4 - protein, 122 aa, Homo sapiens
EVQLVESGGDLVKPGGGLRLSCAASGFTFSSYTMHWVRQAPGKGLEWVSSISSRSRYKYYADSVKGRFTISRDNAKNSLYLQMNSLRAEDTAVYYCARFGIKNKRNWVLDYWGQGTLVTVSS

SEQ ID NO: 5 - protein, 110 aa, Homo sapiens
QSALTQPPSASGSPGQTVTISCTGTSTDVGAYNYVSWYQQHPGKAPKLMIYQVSKRPSGVPDRFSGSKSGNTASLTVSGLQAEDEADYFCSLYTTRPQLAFGGGTKLTVL

SEQ ID NO: 6 - protein, 122 aa, Homo sapiens
EVQLVESGGDLVKPGGGLRLSCAASGFTFSSYTMNWVRQAPGKGLEWVSSISSRSTYAHYADSVKGRFTISRDNAKNSLYLQMNSLRAEDTAVYYCARFGGRGHLLWVFDYWGQGTLVTVSS

SEQ ID NO: 7 - protein, 110 aa, Homo sapiens
QSALTQPPSASGSPGQTVTISCTGTSTDVGTYNYVSWYQQHPGKAPKLMIYQGSKRPSGVPDRFSGSKSGNTASLTVSGLQAEDEADYFCSTVSGDFHVAFGGGTKLTVL

SEQ ID NO: 8 - protein, 122 aa, Homo sapiens
EVQLVESGGDLVKPGGGLRLSCAASGFTFSGYTMHWVRQAPGKGLEWVSSISSRSRYASYADSVKGRFTISRDNAKNSLYLQMNSLRAEDTAVYYCARFGIKNHLNWVFDYWGQGTLVTVSS

SEQ ID NO: 9 - protein, 110 aa, Homo sapiens
QSALTQPPSASGSPGQTVTISCTGTSSDVGDYNYVSWYQQHPGKAPKLMIYGVSKRPSGVPDRFSGSKSGNTASLTVSGLQAEDEADYFCSTVSTSHSPVFGGGTKLTVL

SEQ ID NO: 10 - protein, 122 aa, Homo sapiens
EVQLVESGGDLVKPGGGLRLSCAASGFTFSSHTMNWVRQAPGKGLEWVSSISSRSGYIYYADSVKGRFTISRDNAKNSLYLQMNSLRAEDTAVYYCARYGKREDMLWVFDYWGQGTLVTVSS

SEQ ID NO: 11 - protein, 110 aa, Homo sapiens
QSALTQPPSASGSPGQTVTISCTGTSTDVGDYNYVSWYQQHPGKAPKLMIYETSKKPSGVPDRFSGSKSGNTASLTVSGLQAEDEADYFCSTYAAPLGPMFGGGTKLTVL

SEQ ID NO: 12 - protein, 122 aa, Homo sapiens
EVQLVESGGDLVKPGGGLRLSCAASGFTFSGYTMNWVRQAPGKGLEWVSSISSRSNYISYADSVKGRFTISRDNAKNSLYLQMNSLRAEDTAVYYCARYGALNHMLWVFDYWGQGTLVTVSS

SEQ ID NO: 13 - protein, 110 aa, Homo sapiens
QSALTQPPSASGSPGQTVTISCTGTSTDVGAYNYVSWYQQHPGKAPKLMIYSTSKRPSGVPDRFSGSKSGNTASLTVSGLQAEDEADYFCSLYRYAQGVVFGGGTKLTVL

SEQ ID NO: 14 - protein, 122 aa, Homo sapiens
EVQLVESGGDLVKPGGGLRLSCAASGFTFSTYTMHWVRQAPGKGLEWVSSISSRSGHAHYADSVKGRFTISRDNAKNSLYLQMNSLRAEDTAVYYCARFGRKKKRLWVFDYWGQGTLVTVSS

SEQ ID NO: 15 - protein, 110 aa, Homo sapiens
QSALTQPPSASGSPGQTVTISCTGTSTDVGFYNYVSWYQQHPGKAPKLMIYQNSKRPSGVPDRFSGSKSGNTASLTVSGLQAEDEADYFCSTNRAARSVAFGGGTKLTVL

SEQ ID NO: 16 - protein, 116 aa, Rattus norvegicus
QVQLQESGPGLVKPSETLSLTCTVSGYSISSGYGWNWIRQPPGKGLEWIGFIYYEGSTYYNPSIKSRISITRDTSKNQFFLQVNSVTTEDTATYYCARQTGYFDYWGQGTLVTVSS

SEQ ID NO: 17 - protein, 113 aa, Rattus norvegicus
DIVMTQSPDSLAVSLGERATINCKSSQSLFNSNAKTNYLNWYQQKPGQPPKLLIYYASTRHTGVPDRFSGSGSGTDFTLTISSLQAEDVAVYYCQQWYDYPYTFGAGTKVEIK

SEQ ID NO: 18 - protein, 330 aa, Mus musculus
AKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPDVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 19 - protein, 107 aa, Mus musculus
RADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 20 - protein, 122 aa, Homo sapiens
EVQLVESGGDLVKPGGGLRLSCAASGFTFSSRTMNWVRQAPGKGLEWVSSISTRSGYIYYAESVKGRFTISRDNAKNSLYLQMNSLRAEDTAVYYCARYGKREDMLWVFDYWGQGTLVTVSS

SEQ ID NO: 21 - protein, 110 aa, Homo sapiens
QSALTQPPSASGSPGQTVTISCDGPSTGVGDYNYVHWYQQHPGKAPKLMIYFTSKKPSGVPDRFSGSKSGNTASLTVSGLQAEDEADYFCQTYAAPLGPMFGGGTKLTVL

SEQ ID NO: 22 - protein, 106 aa, Mus musculus
GQPKSSPSVTLFPPSSEELETNKATLVCTITDFYPGVVTVDWKVDGTPVTQGMETTQPSKQSNNKYMASSYLTLTARAWERHSSYSCQVTHEGHTVEKSLSRADCS

SEQ ID NO: 23 - protein, 122 aa, Homo sapiens
EVQLVESGGGLVKPGGSLRLSCAASGFTFSSKTMNWVRQAPGKGLEWVSSISTRSGYIYYARSVKGRFTISRDNAKNSLYLQMNSLRAEDTAVYYCARYGKREDMLWVFDYWGQGTLVTVSS

SEQ ID NO: 24 - protein, 111 aa, Homo sapiens
DIVMTQSPLSLPVTPGEPASISCDGPSTDVGDYNWVHWYQQKPGQAPRLLIYYTSSKPEGVPDRFSGSGSGTDFTLKISRVEAEDVGVYYCQTYAAPLGPTFGQGTKLTVL

SEQ ID NO: 25 - protein, 356 aa, Artificial Sequence
  CTLA4
EAIQVTQPSVVLASSHGVASFPCEYSPSHNTDEVRVTVLRQTNDQMTEVCATTFTEKNTVGFLDYPFCSGTFNESRVNLTIQGLRAVDTGLYLCKVELMYPPPYFVGMGNGTQIYVIDPEPCPDSDFDIEGRMDGCKPCICTVPEVSDVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 26 - protein, 118 aa, Homo sapiens
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 27 - protein, 108 aa, Homo sapiens
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 28 - protein, 127 aa, Homo sapiens
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDF

SEQ ID NO: 29 - protein, 122 aa, Homo sapiens
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSS

SEQ ID NO: 30 - protein, 111 aa, Homo sapiens
DIVMTQSPLSLPVTPGEPASISCDGPSTGVGDYNYVHWYQQKPGQAPRLLIYFTSKKPSGVPDRFSGSGSGTDFTLKISRVEAEDVGVYYCQTYAAPLGPMFGQGTKLEIK

SEQ ID NO: 31 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 32 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPMPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 33 - protein, 107 aa, Homo sapiens [sequence omitted]

SEQ ID NO: 34 - protein, 111 aa, Homo sapiens
DIVMTQSPLSLPVTPGEPASISCQGPSTGVGDYNYVHWYQQKPGQAPRLLIYFTSKKPSGVPDRFSGSGSGTDFTLKISRVEAEDVGVYYCQTYAAPLGPMFGQGTKLEIK

SEQ ID NO: 35 - protein, 122 aa, Homo sapiens
QVQLVESGGGVVQPGGSLRLSCAASGFTFSSKTMNWVRQAPGKGLEWVSSISTQSHYIYYARSVRGRFTISRDNAKNSLYLQMNSLRAEDTAVYYCARYGKREDMLWVFDYWGQGTLVTVSS

SEQ ID NO: 36 - protein, 330 aa, Mus musculus
AKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPDVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLRSDGSYFMYSKLRVEKKNWVERNSYSCSVVHEGLHNHHTTKSFSRTPGK

SEQ ID NO: 37 - protein, 122 aa, Homo sapiens
QVQLVESGGGVVQPGGSLRLSCAASGFTFSSKTMNWVRQAPGKGLEWVSSISTQSHYIYYAESVRGRFTISRDNAKNSLYLQMNSLRAEDTAVYYCARYGAREDMLWVFDYWGQGTLVTVSS

SEQ ID NO: 38 - protein, 330 aa, Mus musculus
AKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPDVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSELRVEKKNWVERNSYSCSVVHEGLHNHHTTKSFSRTPGK

SEQ ID NO: 39 - protein, 110 aa, Homo sapiens
QSALTQPPSASGSPGQSVTISCEGPSTGVGDYNWVHWYQQHPGKAPKLMIYFTSKKPSGVPDRFSGSKSGNTASLTVSGLQAEDEADYYCQTYAAPLGPMFGGGTKLTVL

SEQ ID NO: 40 - protein, 110 aa, Homo sapiens
QSALTQPPSASGSPGQSVTISCEGPSTGVGDYTYVHWYQQHPGKAPKLMIYFTSKKPSGVPDRFSGSKSGNTASLTVSGLQAEDEADYYCQTYAAPLGPMFGGGTKLTVL

SEQ ID NO: 41 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 42 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 43 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 44 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 45 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 46 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 47 - protein, 122 aa, Homo sapiens
EVQLVESGGDLVKPGGGLRLSCAASGFTFSSATMNWVRQAPGKGLEWVSSISTRSGYIYYADSVKGRFTISRDNAKNSLYLQMNSLRAEDTAVYYCARYGKREDMLWVFDYWGQGTLVTVSS

SEQ ID NO: 48 - protein, 110 aa, Homo sapiens
QSALTQPPSASGSPGQTVTISCDGPSTDVGDYNYVSWYQQHPGKAPKLMIYFTSKKPSGVPDRFSGSKSGNTASLTVSGLQAEDEADYFCSTYAAPLGPMFGGGTKLTVL

SEQ ID NO: 49 - protein, 168 aa, Artificial Sequence
  CTLA4
MACLGLRRYKAQLQLPSRTWPFVALLTLLFIPVFSEAIQVTQPSVVLASSHGVASFPCEYSPSHNTDEVRVTVLRQTNDQMTEVCATTFTEKNTVGFLDYPFCSGTFNESRVNLTIQGLRAVDTGLYLCKVELMYPPPYFVGMGNGTQIYVIDPEPCPDSDFHHHHHH

SEQ ID NO: 50 - protein, 188 aa, Artificial Sequence
  CTLA4
MACLGFQRHKARLNLATRTRPYTLLFSLLFIPVFSKAMHVAQPAVVLANSRGIASFVCEYASPGKATEVRVTVLRQADSQVTEVCAATYMMGNELTFLDDSICTGTSSGNQVNLTIQGLRAMDTGLYICKVELMYPPPYYMGIGNGTQIYVIDPEPCPDSDFHHHHHHGGGGSGLNDIFEAQKIEWHE

SEQ ID NO: 51 - protein, 116 aa, Artificial Sequence
  VH
QVQLQQSGPQLVRPGASVKISCKASGYSFTSYWMHWVNQRPGQGLEWIGMIDPSYSETRLNQKFKDKATLTVDKSSSTAYMQLSSPTSEDSAVYYCALYGNYFDYWGQGTTLTVSS

SEQ ID NO: 52 - protein, 107 aa, Artificial Sequence
  VL
DIQMTQSSSSFSVSLGDRVTITCKASEDIYNRLAWYQQKPGNAPRLLISGATSLETGVPSRFSGSGSGKDYTLSITSLQTEDVATYYCQQYWSTPYTFGGGTKLEVK

SEQ ID NO: 53 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 54-62 - skipped (9 entries)

SEQ ID NO: 63 - protein, 107 aa, Artificial Sequence [sequence omitted]

SEQ ID NO: 64 - skipped

SEQ ID NO: 65 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHAHTTRKELSLSP

SEQ ID NO: 66 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 67-80 - skipped (14 entries)

SEQ ID NO: 81 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 82 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 83 - protein, 122 aa, Homo sapiens; identical to SEQ ID NO: 20

SEQ ID NO: 84 - protein, 122 aa, Homo sapiens
EVQLVESGGGLVKPGGSLRLSCAASGFTFSSRTMNWVRQAPGKGLEWVSSISTRSGYIYYAESVKGRFTISRDNAKNSLYLQMNSLRAEDTAVYYCARYGKREDMLWVFDYWGQGTLVTVSS

SEQ ID NO: 85 - protein, 122 aa, Homo sapiens
EVQLVESGGGLVKPGGSLRLSCAASGFTFSSKTMNWVRQAPGKGLEWVSSISTRSGYIYYAESVKGRFTISRDNAKNSLYLQMNSLRAEDTAVYYCARYGKREDMLWVFDYWGQGTLVTVSS

SEQ ID NO: 86 - protein, 122 aa, Homo sapiens; identical to SEQ ID NO: 23

SEQ ID NO: 87 - protein, 106 aa, Artificial Sequence; identical to SEQ ID NO: 53
  CL

SEQ ID NO: 88 - protein, 110 aa, Homo sapiens
QSALTQPPSASGSPGQTVTISCDGPSTDVGDYNYVHWYQQHPGKAPKLMIYFTSKKPSGVPDRFSGSKSGNTASLTVSGLQAEDEADYFCSTYAAPLGPMFGGGTKLTVL

SEQ ID NO: 89 - protein, 110 aa, Homo sapiens
QSALTQPPSASGSPGQTVTISCDGPSTDVGDYNYVSWYQQHPGKAPKLMIYFTSKKPSGVPDRFSGSKSGNTASLTVSGLQAEDEADYFCQTYAAPLGPMFGGGTKLTVL

SEQ ID NO: 90 - protein, 110 aa, Homo sapiens
QSALTQPPSASGSPGQTVTISCDGPSTGVGDYNYVSWYQQHPGKAPKLMIYFTSKKPSGVPDRFSGSKSGNTASLTVSGLQAEDEADYFCSTYAAPLGPMFGGGTKLTVL

SEQ ID NO: 91 - protein, 110 aa, Homo sapiens
QSALTQPPSASGSPGQTVTISCDGPSTDVGDYNWVSWYQQHPGKAPKLMIYFTSKKPSGVPDRFSGSKSGNTASLTVSGLQAEDEADYFCSTYAAPLGPMFGGGTKLTVL

SEQ ID NO: 92 - protein, 110 aa, Homo sapiens
QSALTQPPSASGSPGQTVTISCDGPSTDVGDYNWVHWYQQHPGKAPKLMIYFTSKKPSGVPDRFSGSKSGNTASLTVSGLQAEDEADYFCSTYAAPLGPMFGGGTKLTVL

SEQ ID NO: 93 - protein, 110 aa, Homo sapiens
QSALTQPPSASGSPGQTVTISCDGPSTGVGDYNYVHWYQQHPGKAPKLMIYFTSKKPSGVPDRFSGSKSGNTASLTVSGLQAEDEADYFCSTYAAPLGPMFGGGTKLTVL

SEQ ID NO: 94 - protein, 110 aa, Homo sapiens
QSALTQPPSASGSPGQTVTISCDGPSTDVGDYNYVHWYQQHPGKAPKLMIYFTSKKPSGVPDRFSGSKSGNTASLTVSGLQAEDEADYFCQTYAAPLGPMFGGGTKLTVL

SEQ ID NO: 95 - protein, 111 aa, Homo sapiens; identical to SEQ ID NO: 30

SEQ ID NO: 96 - protein, 107 aa, Artificial Sequence [sequence omitted]

SEQ ID NO: 97 - protein, 110 aa, Homo sapiens; identical to SEQ ID NO: 21

SEQ ID NO: 98 - protein, 122 aa, Homo sapiens; identical to SEQ ID NO: 47

SEQ ID NO: 99 - protein, 110 aa, Homo sapiens; identical to SEQ ID NO: 48

SEQ ID NO: 100 - protein, 5 aa, Homo sapiens
SHTMN

SEQ ID NO: 101 - protein, 17 aa, Homo sapiens
SISSRSGYIYYADSVKG

SEQ ID NO: 102 - protein, 13 aa, Homo sapiens
YGKREDMLWVFDY

SEQ ID NO: 103 - protein, 5 aa, Homo sapiens
SATMN

SEQ ID NO: 104 - protein, 17 aa, Homo sapiens
SISTRSGYIYYADSVKG

SEQ ID NO: 105 - protein, 5 aa, Homo sapiens
SRTMN

SEQ ID NO: 106 - protein, 17 aa, Homo sapiens
SISTRSGYIYYAESVKG

SEQ ID NO: 107 - protein, 5 aa, Homo sapiens
SKTMN

SEQ ID NO: 108 - protein, 17 aa, Homo sapiens
SISTRSGYIYYARSVKG

SEQ ID NO: 109 - protein, 17 aa, Homo sapiens
SISTQSHYIYYARSVKG

SEQ ID NO: 110 - protein, 17 aa, Homo sapiens
SISTQSHYIYYAESVKG

SEQ ID NO: 111 - protein, 17 aa, Homo sapiens
SISTQSHYIYYAESVRG

SEQ ID NO: 112 - protein, 17 aa, Homo sapiens
SISTQSHYIYYARSVRG

SEQ ID NO: 113 - protein, 14 aa, Homo sapiens
TGTSTDVGDYNYVS

SEQ ID NO: 114 - protein, 7 aa, Homo sapiens
ETSKKPS

SEQ ID NO: 115 - protein, 10 aa, Homo sapiens
STYAAPLGPM

SEQ ID NO: 116 - protein, 14 aa, Homo sapiens
DGPSTDVGDYNYVS

SEQ ID NO: 117 - protein, 7 aa, Homo sapiens
FTSKKPS

SEQ ID NO: 118 - protein, 14 aa, Homo sapiens
DGPSTDVGDYNYVH

SEQ ID NO: 119 - protein, 14 aa, Homo sapiens
DGPSTGVGDYNYVS

SEQ ID NO: 120 - protein, 14 aa, Homo sapiens
DGPSTDVGDYNWVS

SEQ ID NO: 121 - protein, 14 aa, Homo sapiens
DGPSTDVGDYNWVH

SEQ ID NO: 122 - protein, 14 aa, Homo sapiens
DGPSTGVGDYNYVH

SEQ ID NO: 123 - protein, 7 aa, Homo sapiens
YTSSKPE

SEQ ID NO: 124 - protein, 14 aa, Homo sapiens
QGPSTGVGDYNWVH

SEQ ID NO: 125 - protein, 7 aa, Homo sapiens
FTSKKPK

SEQ ID NO: 126 - protein, 14 aa, Homo sapiens
QGPSTGVGDYTWVH

SEQ ID NO: 127 - protein, 7 aa, Homo sapiens
FTIKKPK

SEQ ID NO: 128 - protein, 14 aa, Homo sapiens
EGPSTGVGDYNWVH

SEQ ID NO: 129 - protein, 14 aa, Homo sapiens
EGPSTGVGDYTYVH

SEQ ID NO: 130 - protein, 14 aa, Homo sapiens
QGPSTGVGDYNYVH

SEQ ID NO: 131 - protein, 374 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 132 - protein, 316 aa, Homo sapiens
MTMETQMSQNVCPRNLWLLQPLTVLLLLASADSQAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGVIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 133 - protein, 10 aa, Homo sapiens
QTYAAPLGPM

SEQ ID NO: 134 - protein, 111 aa, Homo sapiens
DIVMTQSPLSLPVTPGEPASISCDGPSTDVGDYNWVHWYQQKPGQAPRLLIYYTSSKPEGVPDRFSGSGSGTDFTLKISRVEAEDVGVYYCQTYAAPLGPTFGQGTKLEIK

SEQ ID NO: 135 - protein, 122 aa, Homo sapiens
EVQLVESGGGLVKPGGSLRLSCAASGFTFSSKTMNWVRQAPGKGLEWVSSISTQSHYIYYARSVKGRFTISRDNAKNSLYLQMNSLRAEDTAVYYCARYGKREDMLWVFDYWGQGTLVTVSS

SEQ ID NO: 136 - protein, 122 aa, Homo sapiens; identical to SEQ ID NO: 29

SEQ ID NO: 137 - protein, 122 aa, Homo sapiens
EVQLVESGGGLVKPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSS

SEQ ID NO: 138 - protein, 122 aa, Homo sapiens
QVQLVESGGGLVKPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSS

SEQ ID NO: 139 - protein, 122 aa, Homo sapiens
QVQLVESGGGVVQPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSS

SEQ ID NO: 140 - protein, 122 aa, Homo sapiens; identical to SEQ ID NO: 35

SEQ ID NO: 141 - protein, 122 aa, Homo sapiens; identical to SEQ ID NO: 37

SEQ ID NO: 142 - protein, 317 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 143 - protein, 218 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSRLDPTFSIPQANHSHSGDYHCTGNIGYTLFSSKPVTITVQVPSMGSSSPMGI

SEQ ID NO: 144 - protein, 110 aa, Homo sapiens
QSALTQPPSASGSPGQSVTISCQGPSTGVGDYNWVHWYQQHPGKAPKLMIYFTSKKPKGVPDRFSGSKSGNTASLTVSGLQAEDEADYYCQTYAAPLGPMFGGGTKLTVL

SEQ ID NO: 145 - protein, 110 aa, Homo sapiens
QSALTQPPSASGSPGQSVTISCQGPSTGVGDYTWVHWYQQHPGKAPKLMIYFTIKKPKGVPDRFSGSKSGNTASLTVSGLQAEDEADYYCQTYAAPLGPMFGGGTKLTVL

SEQ ID NO: 146 - protein, 110 aa, Homo sapiens; identical to SEQ ID NO: 39

SEQ ID NO: 147 - protein, 110 aa, Homo sapiens; identical to SEQ ID NO: 40

SEQ ID NO: 148 - protein, 110 aa, Homo sapiens
QSALTQPPSASGSPGQSVTISCQGPSTGVGDYNWVHWYQQHPGKAPKLMIYFTSKKPSGVPDRFSGSKSGNTASLTVSGLQAEDEADYYCQTYAAPLGPMFGGGTKLTVL

SEQ ID NO: 149 - protein, 111 aa, Homo sapiens; identical to SEQ ID NO: 34

SEQ ID NO: 150 - protein, 218 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGI

SEQ ID NO: 151 - protein, 291 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 152 - protein, 13 aa, Homo sapiens
YGAREDMLWVFDY

SEQ ID NO: 153 - protein, 10 aa, Homo sapiens
QTYAAPLGPT

SEQ ID NO: 154 - protein, 118 aa, Artificial Sequence; identical to SEQ ID NO: 26
  VH

SEQ ID NO: 155 - protein, 108 aa, Artificial Sequence; identical to SEQ ID NO: 27
  VL

SEQ ID NO: 156 - protein, 116 aa, Artificial Sequence; identical to SEQ ID NO: 16
  VH

SEQ ID NO: 157 - protein, 113 aa, Artificial Sequence; identical to SEQ ID NO: 17
  VL

SEQ ID NO: 158 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 159 - protein, 107 aa, Artificial Sequence [sequence omitted]

SEQ ID NO: 160 - protein, 450 aa, Artificial Sequence
  Hch
QVQLVESGGGLVKPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 161 - protein, 216 aa, Artificial Sequence
  Lch
QSALTQPPSASGSPGQSVTISCEGPSTGVGDYNWVHWYQQHPGKAPKLMIYFTSKKPSGVPDRFSGSKSGNTASLTVSGLQAEDEADYYCQTYAAPLGPMFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 162 - protein, 450 aa, Artificial Sequence
  Hch
QVQLVESGGGLVKPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 163 - protein, 450 aa, Artificial Sequence
  Hch
QVQLVESGGGLVKPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPMPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 164 - protein, 450 aa, Artificial Sequence
  Hch
QVQLVESGGGLVKPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 165 - protein, 450 aa, Artificial Sequence
  Hch
QVQLVESGGGLVKPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 166 - protein, 450 aa, Artificial Sequence
  Hch
QVQLVESGGGLVKPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 167 - protein, 450 aa, Artificial Sequence
  Hch
QVQLVESGGGLVKPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 168 - protein, 450 aa, Artificial Sequence
  Hch
QVQLVESGGGLVKPGGSLRLSCAASGFTFSSKTMNWVRQAPGKGLEWVSSISTQSHYIYYAESVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 169 - protein, 310 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 170 - protein, 450 aa, Artificial Sequence
  Hch
QVQLVESGGGVVQPGGSLRLSCAASGFTFSSKTMNWVRQAPGKGLEWVSSISTQSHYIYYAESVRGRFTISRDNAKNSLYLQMNSLRAEDTAVYYCARYGAREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 171 - protein, 450 aa, Artificial Sequence
  Hch
QVQLVESGGGVVQPGGSLRLSCAASGFTFSSKTMNWVRQAPGKGLEWVSSISTQSHYIYYAESVRGRFTISRDNAKNSLYLQMNSLRAEDTAVYYCARYGAREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 172 - protein, 217 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAP

SEQ ID NO: 173 - protein, 450 aa, Artificial Sequence
  Hch
QVQLVESGGGVVQPGGSLRLSCAASGFTFSSKTMNWVRQAPGKGLEWVSSISTQSHYIYYAESVRGRFTISRDNAKNSLYLQMNSLRAEDTAVYYCARYGAREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 174 - protein, 254 aa, Homo sapiens [sequence omitted]

SEQ ID NO: 175 - protein, 254 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 176 - protein, 208 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQ

SEQ ID NO: 177 - protein, 208 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQ

SEQ ID NO: 178 - protein, 233 aa, Homo sapiens
MWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 179 - protein, 365 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 180 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 181 - protein, 580 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 182 - protein, 450 aa, Artificial Sequence
  Hch
QVQLVESGGGVVQPGGSLRLSCAASGFTFSSKTMNWVRQAPGKGLEWVSSISTQSHYIYYARSVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 183 - protein, 450 aa, Artificial Sequence
  Hch
QVQLVESGGGVVQPGGSLRLSCAASGFTFSSKTMNWVRQAPGKGLEWVSSISTQSHYIYYARSVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 184 - protein, 450 aa, Artificial Sequence
  Hch
QVQLVESGGGVVQPGGSLRLSCAASGFTFSSKTMNWVRQAPGKGLEWVSSISTQSHYIYYARSVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 185 - protein, 450 aa, Artificial Sequence
  Hch
QVQLVESGGGVVQPGGSLRLSCAASGFTFSSKTMNWVRQAPGKGLEWVSSISTQSHYIYYAESVRGRFTISRDNAKNSLYLQMNSLRAEDTAVYYCARYGAREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTREELSLSP

SEQ ID NO: 186 - protein, 450 aa, Artificial Sequence
  Hch
QVQLVESGGGVVQPGGSLRLSCAASGFTFSSKTMNWVRQAPGKGLEWVSSISTQSHYIYYARSVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 187 - protein, 450 aa, Artificial Sequence
  Hch
QVQLVESGGGVVQPGGSLRLSCAASGFTFSSKTMNWVRQAPGKGLEWVSSISTQSHYIYYAESVRGRFTISRDNAKNSLYLQMNSLRAEDTAVYYCARYGAREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTREELSLSP

SEQ ID NO: 188 - protein, 216 aa, Artificial Sequence
  Lch
QSALTQPPSASGSPGQSVTISCEGPSTGVGDYTYVHWYQQHPGKAPKLMIYFTSKKPSGVPDRFSGSKSGNTASLTVSGLQAEDEADYYCQTYAAPLGPMFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 189 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 190 - protein, 218 aa, Artificial Sequence
  Lch
DIVMTQSPLSLPVTPGEPASISCQGPSTGVGDYNYVHWYQQKPGQAPRLLIYFTSKKPSGVPDRFSGSGSGTDFTLKISRVEAEDVGVYYCQTYAAPLGPMFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 192 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 193 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 194 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 195 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHAHTTRKELSLSP

SEQ ID NO: 196 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 197 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHAHTTRKELSLSP

SEQ ID NO: 198 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 199 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 200 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 201 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 202 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 203 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHAHTTRKELSLSP

SEQ ID NO: 204 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 205 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHAHTTRKELSLSP

SEQ ID NO: 206 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 207 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 208 - protein, 216 aa, Artificial Sequence
  Lch
QSALTQPPSASGSPGQTVTISCDGPSTDVGDYNYVSWYQQHPGKAPKLMIYFTSKKPSGVPDRFSGSKSGNTASLTVSGLQAEDEADYFCSTYAAPLGPMFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 209 - protein, 450 aa, Artificial Sequence
  Hch
EVQLVESGGDLVKPGGGLRLSCAASGFTFSSATMNWVRQAPGKGLEWVSSISTRSGYIYYADSVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 210 - protein, 446 aa, Artificial Sequence
  Hch
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 211 - protein, 215 aa, Artificial Sequence
  Lch
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 212 - protein, 444 aa, Artificial Sequence
  Hch
QVQLQESGPGLVKPSETLSLTCTVSGYSISSGYGWNWIRQPPGKGLEWIGFIYYEGSTYYNPSIKSRISITRDTSKNQFFLQVNSVTTEDTATYYCARQTGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 213 - protein, 220 aa, Artificial Sequence
  Lch
DIVMTQSPDSLAVSLGERATINCKSSQSLFNSNAKTNYLNWYQQKPGQPPKLLIYYASTRHTGVPDRFSGSGSGTDFTLTISSLQAEDVAVYYCQQWYDYPYTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 214 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 215 - protein, 446 aa, Artificial Sequence
  Hch
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 216 - protein, 446 aa, Artificial Sequence
  Hch
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 217 - protein, 446 aa, Artificial Sequence
  Hch
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 218 - protein, 446 aa, Artificial Sequence
  Hch
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPMPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 219 - protein, 446 aa, Artificial Sequence
  Hch
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 220 - protein, 446 aa, Artificial Sequence
  Hch
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 221 - protein, 446 aa, Artificial Sequence
  Hch
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 222 - protein, 446 aa, Artificial Sequence
  Hch
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 223 - protein, 5 aa, Homo sapiens
  MISC_FEATURE (2)..(2): Xaa is His, Ala, Arg, or Lys
SXTMN

SEQ ID NO: 224 - protein, 17 aa, Homo sapiens
  MISC_FEATURE (4)..(4): Xaa is Ser or Thr
  MISC_FEATURE (5)..(5): Xaa is Arg or Gln
  MISC_FEATURE (7)..(7): Xaa is Gly or His
  MISC_FEATURE (13)..(13): Xaa is Asp, Glu, or Arg
  MISC_FEATURE (16)..(16): Xaa is Lys or Arg
SISXXSXYIYYAXSVXG

SEQ ID NO: 225 - protein, 13 aa, Homo sapiens
  MISC_FEATURE (3)..(3): Xaa is Lys or Ala
YGXREDMLWVFDY

SEQ ID NO: 226 - protein, 14 aa, Homo sapiens
  MISC_FEATURE (1)..(1): Xaa is Thr, Asp, Gln, or Glu
  MISC_FEATURE (3)..(3): Xaa is Thr or Pro
  MISC_FEATURE (6)..(6): Xaa is Asp or Gly
  MISC_FEATURE (11)..(11): Xaa is Asn or Thr
  MISC_FEATURE (12)..(12): Xaa is Tyr or Trp
  MISC_FEATURE (14)..(14): Xaa is Ser or His
XGXSTXVGDYXXVX

SEQ ID NO: 227 - protein, 7 aa, Homo sapiens
  MISC_FEATURE (1)..(1): Xaa is Glu, Phe, or Tyr
  MISC_FEATURE (3)..(3): Xaa is Ser or Ile
  MISC_FEATURE (4)..(4): Xaa is Lys or Ser
  MISC_FEATURE (7)..(7): Xaa is Ser, Glu, or Lys
XTXXKPX

SEQ ID NO: 228 - protein, 10 aa, Homo sapiens
  MISC_FEATURE (1)..(1): Xaa is Ser or Gln
  MISC_FEATURE (10)..(10): Xaa is Met or Thr
XTYAAPLGPX

SEQ ID NO: 229 - protein, 30 aa, Homo sapiens
EVQLVESGGDLVKPGGGLRLSCAASGFTFS

SEQ ID NO: 230 - protein, 30 aa, Homo sapiens
EVQLVESGGGLVKPGGSLRLSCAASGFTFS

SEQ ID NO: 231 - protein, 30 aa, Homo sapiens
QVQLVESGGGLVKPGGSLRLSCAASGFTFS

SEQ ID NO: 232 - protein, 30 aa, Homo sapiens
QVQLVESGGGVVQPGGSLRLSCAASGFTFS

SEQ ID NO: 233 - protein, 14 aa, Homo sapiens
WVRQAPGKGLEWVS

SEQ ID NO: 234 - protein, 32 aa, Homo sapiens
RFTISRDNAKNSLYLQMNSLRAEDTAVYYCAR

SEQ ID NO: 235 - protein, 11 aa, Homo sapiens
WGQGTLVTVSS

SEQ ID NO: 236 - protein, 22 aa, Homo sapiens
QSALTQPPSASGSPGQTVTISC

SEQ ID NO: 237 - protein, 22 aa, Homo sapiens
QSALTQPPSASGSPGQSVTISC

SEQ ID NO: 238 - protein, 23 aa, Homo sapiens
DIVMTQSPLSLPVTPGEPASISC

SEQ ID NO: 239 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHAHTTRKELSLSP

SEQ ID NO: 240 - protein, 15 aa, Homo sapiens
WYQQHPGKAPKLMIY

SEQ ID NO: 241 - protein, 15 aa, Homo sapiens
WYQQKPGQAPRLLIY

SEQ ID NO: 242 - protein, 32 aa, Homo sapiens
GVPDRFSGSKSGNTASLTVSGLQAEDEADYFC

SEQ ID NO: 243 - protein, 32 aa, Homo sapiens
GVPDRFSGSKSGNTASLTVSGLQAEDEADYYC

SEQ ID NO: 244 - protein, 32 aa, Homo sapiens
GVPDRFSGSGSGTDFTLKISRVEAEDVGVYYC

SEQ ID NO: 245 - protein, 10 aa, Homo sapiens
FGGGTKLTVL

SEQ ID NO: 246 - protein, 10 aa, Homo sapiens
FGQGTKLEIK

SEQ ID NO: 247 - protein, 223 aa, Mus musculus
MACLGLRRYKAQLQLPSRTWPFVALLTLLFIPVFSEAIQVTQPSVVLASSHGVASFPCEYSPSHNTDEVRVTVLRQTNDQMTEVCATTFTEKNTVGFLDYPFCSGTFNESRVNLTIQGLRAVDTGLYLCKVELMYPPPYFVGMGNGTQIYVIDPEPCPDSDFLLWILVAVSLGLFFYSFLVTAVSLSKMLKKRSPLTTGVYVKMPPTEPECEKQFQPYFIPIN

SEQ ID NO: 248 - protein, 223 aa, Macaca fascicularis
MACLGFQRHKARLNLATRTRPYTLLFSLLFIPVFSKAMHVAQPAVVLANSRGIASFVCEYASPGKATEVRVTVLRQADSQVTEVCAATYMMGNELTFLDDSICTGTSSGNQVNLTIQGLRAMDTGLYICKVELMYPPPYYMGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 249 - protein, 330 aa, Homo sapiens [sequence omitted]

SEQ ID NO: 250 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 251 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 252 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 253 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 254 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 255 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 256 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 257 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 258 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 259 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 260 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTREELSLSP

SEQ ID NO: 261 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 262 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 263 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 264 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 265 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 266 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 267 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 268 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 269 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHAHTTRKELSLSP

SEQ ID NO: 270 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 271 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHAHTTRKELSLSP

SEQ ID NO: 272 - protein, 450 aa, Artificial Sequence
  Hch
QVQLVESGGGVVQPGGSLRLSCAASGFTFSSKTMNWVRQAPGKGLEWVSSISTQSHYIYYAESVRGRFTISRDNAKNSLYLQMNSLRAEDTAVYYCARYGAREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTREELSLSP

SEQ ID NO: 273 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 274 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 275 - protein, 218 aa, Artificial Sequence
  Lch
DIVMTQSPLSLPVTPGEPASISCDGPSTGVGDYNYVHWYQQKPGQAPRLLIYFTSKKPSGVPDRFSGSGSGTDFTLKISRVEAEDVGVYYCQTYAAPLGPMFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 276 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTREELSLSP

SEQ ID NO: 277 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 278 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 279 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 280 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 281 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPMPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 282 - protein, 213 aa, Artificial Sequence
  Lch
DIQMTQSPSSLSASVGDRVTITCRASQDIHKYIAWYQQKPGQAPRLLIQYTSTLQPGVPSRFSGSGSGTDYTFTISSLQPEDIATYYCLQYEQLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 283 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 284 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 285 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDTLMISRTPEVTCVVVDVSDEEPEVKFNWYVDGVEVHNAKTKPREEQYNATYRVVSVLTVLHQDWLNGKEYKCKVSNDALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 286 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDTLMISRTPEVTCVVVDVSHEEPEVKFNWYVDGVEVHNAKTKPREEQYNATYRVVSVLTVLHQDWLNGKEYKCKVSNDALPAPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 287 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPMPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 288 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPMPEEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 289 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 290 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 291 - protein, 444 aa, Artificial Sequence; identical to SEQ ID NO: 289
  Hch

SEQ ID NO: 292 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPKPDEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 293 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 294 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 295 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPAPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 296 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 297 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 298 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 299 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPMPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 300 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDVLMISRTPEVTCVVVDVSHEEPEVKFNWYVDGVEVHNAKTKPREEQYNATYRVVSVLPVLHQDWLNGKEYKCKVSNDALPMPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 301 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 302 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 303 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 304 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 305 - protein, 444 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 306 - protein, 441 aa, Artificial Sequence
  Hch
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSL

SEQ ID NO: 307 - protein, 328 aa, Artificial Sequence; identical to SEQ ID NO: 158
  CH

SEQ ID NO: 308 - protein, 328 aa, Artificial Sequence; identical to SEQ ID NO: 31
  CH

SEQ ID NO: 309 - protein, 328 aa, Artificial Sequence; identical to SEQ ID NO: 32
  CH

SEQ ID NO: 310 - protein, 107 aa, Artificial Sequence [sequence omitted]

SEQ ID NO: 311 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 312 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 313 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDTLMISRTPEVTCVVVDVSDEEPEVKFNWYVDGVEVHNAKTKPREEQYNATYRVVSVLTVLHQDWLNGKEYKCKVSNDALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 314 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDTLMISRTPEVTCVVVDVSHEEPEVKFNWYVDGVEVHNAKTKPREEQYNATYRVVSVLTVLHQDWLNGKEYKCKVSNDALPAPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 315 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPMPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 316 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPMPEEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 317 - protein, 328 aa, Artificial Sequence; identical to SEQ ID NO: 43
  CH

SEQ ID NO: 318 - protein, 328 aa, Artificial Sequence; identical to SEQ ID NO: 253
  CH

SEQ ID NO: 319 - protein, 328 aa, Artificial Sequence; identical to SEQ ID NO: 43
  CH

SEQ ID NO: 320 - protein, 328 aa, Artificial Sequence; identical to SEQ ID NO: 44
  CH

SEQ ID NO: 321 - protein, 328 aa, Artificial Sequence; identical to SEQ ID NO: 45
  CH

SEQ ID NO: 322 - protein, 328 aa, Artificial Sequence; identical to SEQ ID NO: 46
  CH

SEQ ID NO: 323 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPAPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 324 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPEEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 325 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 326 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 327 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPMPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 328 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDVLMISRTPEVTCVVVDVSHEEPEVKFNWYVDGVEVHNAKTKPREEQYNATYRVVSVLPVLHQDWLNGKEYKCKVSNDALPMPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 329 - protein, 328 aa, Artificial Sequence; identical to SEQ ID NO: 42
  CH

SEQ ID NO: 330 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 331 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 332 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 333 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 334 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSL

SEQ ID NO: 335 - protein, 450 aa, Artificial Sequence
  Hch
QVQLVESGGGVVQPGGSLRLSCAASGFTFSSKTMNWVRQAPGKGLEWVSSISTQSHYIYYARSVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPMPEEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 336 - protein, 450 aa, Artificial Sequence
  Hch
QVQLVESGGGVVQPGGSLRLSCAASGFTFSSKTMNWVRQAPGKGLEWVSSISTQSHYIYYAESVRGRFTISRDNAKNSLYLQMNSLRAEDTAVYYCARYGAREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPMPEEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 337 - protein, 450 aa, Artificial Sequence
  Hch
QVQLVESGGGVVQPGGSLRLSCAASGFTFSSKTMNWVRQAPGKGLEWVSSISTQSHYIYYARSVRGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPMPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 338 - protein, 450 aa, Artificial Sequence
  Hch
QVQLVESGGGVVQPGGSLRLSCAASGFTFSSKTMNWVRQAPGKGLEWVSSISTQSHYIYYAESVRGRFTISRDNAKNSLYLQMNSLRAEDTAVYYCARYGAREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDVLMISRTPEVTCVVVDVSHEEPEVKFNWYVDGVEVHNAKTKPREEQYNATYRVVSVLPVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 339 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEYQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 340 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPMPIEETISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 341 - protein, 294 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPHHHHHH

SEQ ID NO: 342 - protein, 224 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIHHHHHH

SEQ ID NO: 343 - protein, 224 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSRLDPTFSIPQANHSHSGDYHCTGNIGYTLFSSKPVTITVQVPSMGSSSPMGIHHHHHH

SEQ ID NO: 344 - protein, 223 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPHHHHHH

SEQ ID NO: 345 - protein, 214 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQHHHHHH

SEQ ID NO: 346 - protein, 214 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQHHHHHH

SEQ ID NO: 347 - protein, 294 aa, Macaca fascicularis
MWFLTALLLWVPVDGQVDTTKAVITLQPPWVSVFQEETVTLQCEVPRLPGSSSTQWFLNGTATQTSTPSYRITSASVKDSGEYRCQRGPSGRSDPIQLEIHRDWLLLQVSSRVFTEGEPLALRCHAWKDKLVYNVLYYQNGKAFKFFYRNSQLTILKTNISHNGAYHCSGMGKHRYTSAGVSVTVKELFPAPVLNASVTSPLLEGNLVTLSCETKLLLQRPGLQLYFSFYMGSKTLRGRNTSSEYQILTARREDSGFYWCEATTEDGNVLKRSPELELQVLGLQLPTPHHHHHH

SEQ ID NO: 348 - protein, 217 aa, Macaca fascicularis
MSQNVCPGNLWLLQPLTVLLLLASADSQTAPPKAVLKLEPPWINVLREDSVTLTCGGAHSPDSDSTQWFHNGNLIPTHTQPSYRFKANNNDSGEYRCQTGRTSLSDPVHLTVLSEWLALQTPHLEFREGETIMLRCHSWKDKPLIKVTFFQNGIAKKFSHMDPNFSIPRANHSHSGDYHCTGNIGYTPYSSKPVTITVQVPSVGSSSPMGIHHHHHH

SEQ ID NO: 349 - protein, 217 aa, Macaca fascicularis
MSQNVCPGNLWLLQPLTVLLLLASADSQTAPPKAVLKLEPPWINVLREDSVTLTCGGAHSPDSDSTQWFHNGNLIPTHTQPSYRFKANNNDSGEYRCQTGRTSLSDPVHLTVLSEWLALQTTHLEFREGETIMLRCHSWKDKPLIKVAFFQNGKSKNFSHMNPNFSIPQANHSHSGDYHCTGNIGYTPYSSKPVTITVQVPSVGSSSPMGIHHHHHH

SEQ ID NO: 350 - protein, 217 aa, Macaca fascicularis
MSQNVCPGNLWLLQPLTVLLLLASADSQTAPPKAVLKLEPPWINVLREDSVTLTCGGAHSPDSDSTQWFHNGNLIPTHTQPSYRFKANNNDSGEYRCQTGRTSLSDPVHLTVLSEWLALQTTHLEFREGETIMLRCHSWKDKPLIKVAFFQNGISKKFSPMNPNFSIPRANHSHSGDYHCTGNIGYTPYSSKPVTITVQVPSVGSSSPMGIHHHHHH

SEQ ID NO: 351 - protein, 223 aa, Macaca fascicularis
MGILSFLPVLATESDWADCKSSQPWGHMLLWTAVLFLAPVAGTPAAPPKAVLKLEPPWINVLREDSVTLTCGGAHSPDSDSTQWFHNGNLIPTHTQPSYRFKANNNDSGEYRCQTGRTSLSDPVHLTVLSEWLALQTPHLEFREGETIMLRCHSWKDKPLIKVTFFQNGISKKFSHMNPNFSIPQANHSHSGDYHCTGNIGYTPYSSKPVTITVQVPHHHHHH

SEQ ID NO: 352 - protein, 214 aa, Macaca fascicularis
MWQLLLPTALLLLVSAGMRAEDLPKAVVFLEPQWYRVLEKDRVTLKCQGAYSPEDNSTRWFHNESLISSQTSSYFIAAARVNNSGEYRCQTSLSTLSDPVQLEVHIGWLLLQAPRWVFKEEESIHLRCHSWKNTLLHKVTYLQNGKGRKYFHQNSDFYIPKATLKDSGSYFCRGLIGSKNVSSETVNITITQDLAVSSISSFFPPGYQHHHHHH

SEQ ID NO: 353 - protein, 214 aa, Macaca fascicularis
MWQLLLPTALLLLVSAGMRAEDLPKAVVFLEPQWYRVLEKDSVTLKCQGAYSPEDNSTRWFHNESLISSQTSSYFIAAARVNNSGEYRCQTSLSTLSDPVQLEVHIGWLLLQAPRWVFKEEESIHLRCHSWKNTLLHKVTYLQNGKGRKYFHQNSDFYIPKATLKDSGSYFCRGLIGSKNVSSETVNITITQDLAVSSISSFFPPGYQHHHHHH

SEQ ID NO: 354 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 355 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHAHTTRKELSLSP

SEQ ID NO: 356 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 357 - protein, 450 aa, Artificial Sequence
  Hch
EVQLVESGGGLVKPGGSLRLSCAASGFTFSSKTMNWVRQAPGKGLEWVSSISTQSHYIYYAESVKGRFTISRDNAKNSLYLQMNSLRAEDTAVYYCARYGKREDMLWVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 358 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPMPEEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 359 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPMPEEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 360 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNKALPMPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 361 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDVLMISRTPEVTCVVVDVSHEEPEVKFNWYVDGVEVHNAKTKPREEQYNATYRVVSVLPVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 362 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEYQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 363 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPMPIEETISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 364 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 365 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFQWGPMVFLFPPKPKDVLMISRTPEVTCVVVDVSDEEPEVKFNWYVDGVEVHNAKTKPREEQYNATYRVVSVLPVLHQDWLNGKEYKCKVSNDALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHAHTTRKELSLSP

SEQ ID NO: 366 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 367 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDVLMISRTPEVTCVVVDVSHEEPEVKFNWYVDGVEVHNAKTKPREEQYNATYRVVSVLPVLHQDWLNGKEYKCKVSNDALPAPIEETISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHAHTTRKELSLSP

SEQ ID NO: 368 - protein, 450 aa, Artificial Sequence; identical to SEQ ID NO: 337
  Hch

SEQ ID NO: 369 - protein, 450 aa, Artificial Sequence; identical to SEQ ID NO: 338
  Hch

SEQ ID NO: 370 - protein, 450 aa, Artificial Sequence; identical to SEQ ID NO: 354
  Hch

SEQ ID NO: 371 - protein, 450 aa, Artificial Sequence; identical to SEQ ID NO: 355
  Hch

SEQ ID NO: 372 - protein, 450 aa, Artificial Sequence; identical to SEQ ID NO: 356
  Hch

SEQ ID NO: 373 - protein, 450 aa, Artificial Sequence; identical to SEQ ID NO: 357
  Hch

SEQ ID NO: 374 - protein, 444 aa, Artificial Sequence
  Hch
QVQLQQSGPQLVRPGASVKISCKASGYSFTSYWMHWVNQRPGQGLEWIGMIDPSYSETRLNQKFKDKATLTVDKSSSTAYMQLSSPTSEDSAVYYCALYGNYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 375 - protein, 214 aa, Artificial Sequence
  Lch
DIQMTQSSSSFSVSLGDRVTITCKASEDIYNRLAWYQQKPGNAPRLLISGATSLETGVPSRFSGSGSGKDYTLSITSLQTEDVATYYCQQYWSTPYTFGGGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 376 - protein, 328 aa, Artificial Sequence; identical to SEQ ID NO: 360
  CH

SEQ ID NO: 377 - protein, 328 aa, Artificial Sequence; identical to SEQ ID NO: 361
  CH

SEQ ID NO: 378 - protein, 328 aa, Artificial Sequence; identical to SEQ ID NO: 364
  CH

SEQ ID NO: 379 - protein, 328 aa, Artificial Sequence; identical to SEQ ID NO: 365
  CH

SEQ ID NO: 380 - protein, 328 aa, Artificial Sequence; identical to SEQ ID NO: 366
  CH

SEQ ID NO: 381 - protein, 328 aa, Artificial Sequence; identical to SEQ ID NO: 367
  CH

SEQ ID NO: 382 - protein, 324 aa, Gallus gallus
  misc_feature (92)..(92): Xaa can be any naturally occurring amino acid
  misc_feature (111)..(111): Xaa can be any naturally occurring amino acid
LPGFGDSIEAQCGTSVNVHSSLRDILNQITKPNDVYSFSLASRLYAEERYPILPEYLQCVKELYRGGLEPINFQTAADQARELINSWVESQXNGIIRNVLQPSSVDSQTAXVLVNAIVFKGLWEKAFKDEDTQAMPFRVTEQESKPVQMMYQIGLFRVASMASEKMKILELPFASGTMSMLVLLPDEVSGLEQLESIINFEKLTEWTSSNVMEERKIKVYFPRMKMEEKYNLTSVLMAMGITDVFSSSANLSGISSAESLKISQAVHAAHAEINEAGREVVGSAEAGVDAASVSEEFRADHPFLFCIKHIATNAVLFFGRCVSP

SEQ ID NO: 383 - protein, 328 aa, Artificial Sequence; identical to SEQ ID NO: 358
  CH

SEQ ID NO: 384 - protein, 328 aa, Artificial Sequence; identical to SEQ ID NO: 359
  CH

SEQ ID NO: 385 - protein, 450 aa, Artificial Sequence; identical to SEQ ID NO: 335
  Hch

SEQ ID NO: 386 - protein, 450 aa, Artificial Sequence; identical to SEQ ID NO: 336
  Hch

The invention claimed is:

1. A method of treating an individual having a tumor comprising administering to the individual an effective amount of an anti-CTLA-4 antibody comprising:
(A) a variable region comprising
  (i) a variable region comprising the VH sequence of SEQ ID NO: 98 and the VL sequence of SEQ ID NO: 99;
  (ii) a variable region comprising the VH sequence of SEQ ID NO: 83 and the VL sequence of SEQ ID NO: 88;
  (iii) a variable region comprising the VH sequence of SEQ ID NO: 83 and the VL sequence of SEQ ID NO: 89;
  (iv) a variable region comprising the VH sequence of SEQ ID NO: 83 and the VL sequence of SEQ ID NO: 90;
  (v) a variable region comprising the VH sequence of SEQ ID NO: 83 and the VL sequence of SEQ ID NO: 91;
  (vi) a variable region comprising the VH sequence of SEQ ID NO: 83 and the VL sequence of SEQ ID NO: 92;
  (vii) a variable region comprising the VH sequence of SEQ ID NO: 83 and the VL sequence of SEQ ID NO: 93;
  (viii) a variable region comprising the VH sequence of SEQ ID NO: 83 and the VL sequence of SEQ ID NO: 94;
  (ix) a variable region comprising the VH sequence of SEQ ID NO: 83 and the VL sequence of SEQ ID NO: 97;
  (x) a variable region comprising the VH sequence of SEQ ID NO: 83 and the VL sequence of SEQ ID NO: 95;
  (xi) a variable region comprising the VH sequence of SEQ ID NO: 84 and the VL sequence of SEQ ID NO: 97;
  (xii) a variable region comprising the VH sequence of SEQ ID NO: 85 and the VL sequence of SEQ ID NO: 97;
  (xiii) a variable region comprising the VH sequence of SEQ ID NO: 86 and the VL sequence of SEQ ID NO: 97;
  (xiv) a variable region comprising the VH sequence of SEQ ID NO: 86 and the VL sequence of SEQ ID NO: 134;
  (xv) a variable region comprising the VH sequence of SEQ ID NO: 136 and the VL sequence of SEQ ID NO: 97;
  (xvi) a variable region comprising the VH sequence of SEQ ID NO: 135 and the VL sequence of SEQ ID NO: 97;
  (xvii) a variable region comprising the VH sequence of SEQ ID NO: 136 and the VL sequence of SEQ ID NO: 95;
  (xviii) a variable region comprising the VH sequence of SEQ ID NO: 137 and the VL sequence of SEQ ID NO: 97;
  (xix) a variable region comprising the VH sequence of SEQ ID NO: 138 and the VL sequence of SEQ ID NO: 97;
  (xx) a variable region comprising the VH sequence of SEQ ID NO: 138 and the VL sequence of SEQ ID NO: 144;
  (xxi) a variable region comprising the VH sequence of SEQ ID NO: 138 and the VL sequence of SEQ ID NO: 145;
  (xxii) a variable region comprising the VH sequence of SEQ ID NO: 138 and the VL sequence of SEQ ID NO: 146;
  (xxiii) a variable region comprising the VH sequence of SEQ ID NO: 139 and the VL sequence of SEQ ID NO: 146;
  (xxiv) a variable region comprising the VH sequence of SEQ ID NO: 140 and the VL sequence of SEQ ID NO: 146;
  (xxv) a variable region comprising the VH sequence of SEQ ID NO: 141 and the VL sequence of SEQ ID NO: 146;
  (xxvi) a variable region comprising the VH sequence of SEQ ID NO: 140 and the VL sequence of SEQ ID NO: 147;
  (xxvii) a variable region comprising the VH sequence of SEQ ID NO: 141 and the VL sequence of SEQ ID NO: 147;
  (xxviii) a variable region comprising the VH sequence of SEQ ID NO: 140 and the VL sequence of SEQ ID NO: 148;
  (xxix) a variable region comprising the VH sequence of SEQ ID NO: 141 and the VL sequence of SEQ ID NO: 148;
  (xxx) a variable region comprising the VH sequence of SEQ ID NO: 136 and the VL sequence of SEQ ID NO: 149;
  (xxxi) a first heavy chain variable region comprising the VH sequence of SEQ ID NO: 140 and a first light chain variable region comprising the VL sequence of SEQ ID NO: 146, and a second heavy chain variable region comprising the VH sequence of SEQ ID NO: 141 and a second light chain variable region comprising the VL sequence of SEQ ID NO: 146; or (xxxii) a first heavy chain variable region comprising the VH sequence of SEQ ID NO: 140 and a first light chain variable region comprising the VL sequence of SEQ ID NO: 147, and a second heavy chain variable region comprising the VH sequence of SEQ ID NO: 141 and a second light chain variable region comprising the VL sequence of SEQ ID NO: 147; and (B) a heavy chain constant region domain comprising:
(i) a first polypeptide of SEQ ID NO: 383 and a second polypeptide of SEQ ID NO: 384, or
(ii) a first polypeptide of SEQ ID NO: 376 and a second polypeptide of SEQ ID NO: 377, wherein the tumor is selected from the group consisting of lung cancer, large intestine cancer, colon cancer, breast cancer, liver cancer, pancreatic cancer, renal cancer, bladder cancer, head and neck cancer, and melanoma.

2. A method of treating an individual having a tumor comprising administering to the individual an effective amount of an anti-CTLA-4 antibody comprising:
(1) a first heavy chain polypeptide of SEQ ID NO: 385, a second heavy chain polypeptide of SEQ ID NO: 386, and a light chain polypeptide of SEQ ID NO: 161; or
(2) a first heavy chain polypeptide of SEQ ID NO: 368, a second heavy chain polypeptide of SEQ ID NO: 369, and a light chain polypeptide of SEQ ID NO: 161,
wherein the tumor is selected from the group consisting of lung cancer, large intestine cancer, colon cancer, breast cancer, liver cancer, pancreatic cancer, renal cancer, bladder cancer, head and neck cancer, and melanoma.

3. The method of claim 1, wherein the administered anti-CTLA-4 antibody comprises a variable region comprising the VH sequence of SEQ ID NO: 140 or SEQ ID NO: 141 and the VL sequence of SEQ ID NO: 146.

4. The method of claim 1, wherein the administered anti-CTLA-4 antibody comprises a variable region comprising the VH sequence of SEQ ID NO: 140 or SEQ ID NO:141 and the VL sequence of SEQ ID NO: 147.

5. The method of claim 1, wherein the administered anti-CTLA-4 antibody comprises a first heavy chain variable region comprising the VH sequence of SEQ ID NO: 140 and a first light chain variable region comprising the VL sequence of SEQ ID NO: 146, and a second heavy chain variable region comprising the VH sequence of SEQ ID NO: 141 and a second light chain variable region comprising the VL sequence of SEQ ID NO: 146.

6. The method of claim 1, wherein the administered anti-CTLA-4 antibody comprises a first heavy chain variable region comprising the VH sequence of SEQ ID NO: 140 and a first light chain variable region comprising the VL sequence of SEQ ID NO: 147, and a second heavy chain variable region comprising the VH sequence of SEQ ID NO: 141 and a second light chain variable region comprising the VL sequence of SEQ ID NO: 147.

7. The method of claim 1, wherein the administered anti-CTLA-4 antibody comprises a heavy chain constant region domain comprising a first polypeptide of SEQ ID NO: 383 and a second polypeptide of SEQ ID NO: 384.

8. The method of claim 3, wherein the administered anti-CTLA-4 antibody comprises a heavy chain constant region domain comprising a first polypeptide of SEQ ID NO: 383 and a second polypeptide of SEQ ID NO: 384.

9. The method of claim 4, wherein the administered anti-CTLA-4 antibody comprises a heavy chain constant region domain comprising a first polypeptide of SEQ ID NO: 383 and a second polypeptide of SEQ ID NO: 384.

10. The method of claim 5, wherein the administered anti-CTLA-4 antibody comprises a heavy chain constant region domain comprising a first polypeptide of SEQ ID NO: 383 and a second polypeptide of SEQ ID NO: 384.

11. The method of claim 6, wherein the administered anti-CTLA-4 antibody comprises a heavy chain constant region domain comprising a first polypeptide of SEQ ID NO: 383 and a second polypeptide of SEQ ID NO: 384.

12. The method of claim 1, wherein the administered anti-CTLA-4 antibody comprises a heavy chain constant region domain comprising a first polypeptide of SEQ ID NO: 376 and a second polypeptide of SEQ ID NO: 377.

13. The method of claim 3, wherein the administered anti-CTLA-4 antibody comprises a heavy chain constant region domain comprising a first polypeptide of SEQ ID NO: 376 and a second polypeptide of SEQ ID NO: 377.

14. The method of claim 4, wherein the administered anti-CTLA-4 antibody comprises a heavy chain constant region domain comprising a first polypeptide of SEQ ID NO: 376 and a second polypeptide of SEQ ID NO: 377.

15. The method of claim 5, wherein the administered anti-CTLA-4 antibody comprises a heavy chain constant region domain comprising a first polypeptide of SEQ ID NO: 376 and a second polypeptide of SEQ ID NO: 377.

16. The method of claim 6, wherein the administered anti-CTLA-4 antibody comprises a heavy chain constant region domain comprising a first polypeptide of SEQ ID NO: 376 and a second polypeptide of SEQ ID NO: 377.

17. The method of claim 2, wherein the administered anti-CTLA-4 antibody comprises a first heavy chain polypeptide of SEQ ID NO: 385, a second heavy chain polypeptide of SEQ ID NO: 386, and a light chain polypeptide of SEQ ID NO: 161.

18. The method of claim 2, wherein the administered anti-CTLA-4 antibody comprises a first heavy chain polypeptide of SEQ ID NO: 368, a second heavy chain polypeptide of SEQ ID NO: 369, and a light chain polypeptide of SEQ ID NO: 161.

19. The method of claim 1, wherein the tumor is selected from the group consisting of lung cancer, large intestine cancer, colon cancer, head and neck cancer, and melanoma.

20. The method of claim 2, wherein the tumor is selected from the group consisting of lung cancer, large intestine cancer, colon cancer, head and neck cancer, and melanoma.

* * * * *